US006806054B2

(12) United States Patent
Lehmann-Bruinsma et al.

(10) Patent No.: US 6,806,054 B2
(45) Date of Patent: Oct. 19, 2004

(54) NON-ENDOGENOUS, CONSTITUTIVELY ACTIVATED KNOWN G PROTEIN-COUPLED RECEPTORS

(75) Inventors: Karin Lehmann-Bruinsma, San Diego, CA (US); Chen W. Liaw, San Diego, CA (US); I-Lin Lin, San Diego, CA (US)

(73) Assignee: Arena Pharmaceuticals, Inc., San Diego, CA (US)

( * ) Notice: Subject to any disclaimer, the term of this patent is extended or adjusted under 35 U.S.C. 154(b) by 116 days.

(21) Appl. No.: 09/826,509

(22) Filed: Apr. 5, 2001

(65) Prior Publication Data

US 2003/0204073 A1 Oct. 30, 2003

Related U.S. Application Data

(60) Provisional application No. 60/195,747, filed on Apr. 7, 2000.

(51) Int. Cl.$^7$ .............................................. G01N 33/53
(52) U.S. Cl. ....................................... 435/7.1; 436/501
(58) Field of Search ................................ 435/7.21, 7.1, 435/7.2; 436/501

(56) References Cited

U.S. PATENT DOCUMENTS

| 6,107,324 | A | * | 8/2000 | Behan et al. | ............... | 514/406 |
| 6,140,509 | A | * | 10/2000 | Behan et al. | ............ | 548/365.7 |
| 6,150,393 | A | * | 11/2000 | Behan et al. | ............... | 514/406 |
| 6,358,698 | B1 | * | 3/2002 | Weiner et al. | ............. | 435/7.21 |

FOREIGN PATENT DOCUMENTS

| WO | WO 95/00848 | 1/1995 |
| WO | WO 96/37775 | 11/1996 |
| WO | WO 98/31828 | 7/1998 |
| WO | WO 98/38217 | 9/1998 |
| WO | WO 99/52927 | 10/1999 |
| WO | WO 00/06597 | 2/2000 |

OTHER PUBLICATIONS

Herrick–Davis et al. Pharmacological characterization of the constitutively activated state of the serotonin 5–HT2c receptor. Annals of the New York Academy of Sciences 861:140–145, 1998.*

Adachi, M. et al., "Cloning and characterization of cDNA encoding human a–typr endothelin receptor", *Biochem Biophys Res Commun*,1991, 180(3), 1265.

Adamou, J.E. et al., "Cloning and functional characterization of the human vasoactive intestinal peptide (VIP)2 receptor", *Biochem Biophys Res Commun*, 1995, 209(2), 385.

Adham, N. et al., "Cloning of another human serotonin receptor (5–HT1f): a fifth 5 HT1 receptor subtype coupled to the inhibition of adenylate cyclase" *Proc Natl Acad Sci USA*, 1993, 90, pp 408–412.

Ames, R. et al., "Molecular cloning and characterization of the human anaphylatoxin C3a receptor",*J. Biol Chem*, 1996, 271(34), pp. 20231–20234.

Bard, J.A. et al., "Cloning of a novel human serotonin receptor (5–HT7) positively linked to adenylate cyclase", *J. Biol Chem*, 1993, 268(31), pp 23422–23426.

Bastien, L. et al., "Cloning functional expression and characterization of the human prostaglandin E2 receptor EP2 subtype", *J. Biol Chem*, 1994, 269(16), pp 11873–11877.

Blondel, O. et al., "Cloning, expression and pharmacology of four human 5–hydroxytryptamine 4 receptor isoforms produced by alternative splicing in the carboxyl terminus", *J Neurochem*, 1998, 70, pp 2252–2261.

Bonner, T.I. et al., "Cloning and expression of the human and rat m5 muscarine acetylcholine receptor genes", *Neuron*, 1988, 1(5), pp. 403–410.

Chow, B.K. "Molecular cloning and functional characterization of a human secretin receptor", *Biochem Biophys Res Commun*, 1995, 212(1),pp 204–211.

Claeysen, S. et al., "Novel brain specific 5–HT4 receptor splice variants show marked constitutive activity; role to the C–terminal intracellular domain" *Mol Pharmacol*, 1999, 5(5), pp 910–920.

Corjay, M.H. et al., "Two Distinct bombesin receptor subtypes are expressed and functional in human lung carcinoma cells", *J Biol Chem*, 1991, 266, pp 18771–18779.

Dearry, A. et al., "Molecular cloning and expression of the gene for a human D1 dopamine receptor", *Nature*, 1990, 347, pp 72–76.

Dearry, A. et al., "D2 dopamine receptors in the human retina: cloning of cDNA and localization of mRNA", *Cell Mol. Neurobiol*, 1991, 11(5),pp 437–451.

Fathi, Z. et al., "BRS–3: a novel bombesin receptor subtype selectively expressed in testis and lung carcinoma cells", *J. Biol Chem*, 1993,268(8), pp 5979–5984.

Fathi, Z. et al., "Cloning 1991, pharmacological characterization and distribution of a novel galanin receptor", *Brain Res Mol Brain Res*, 1997, 51, pp 49–59.

Fay, M.J., et al., "Evidence for expression of vasopressin V2 receptor mRNA in human lung", *Peptides*, 1996, 17(3), pp 477–481.

Feliciello A. et al., "Expression of thyrotropin receptor mRNA in healthy and graves disease retro orbital tissue", *Lancet*,1993, 342, pp 337–338.

(List continued on next page.)

*Primary Examiner*—Yvonne Eyler
*Assistant Examiner*—Ruixiang Li
(74) *Attorney, Agent, or Firm*—Michael P. Straher; Cozen O'Connor

(57) ABSTRACT

The invention disclosed in this patent document relates to transmembrane receptors, more particularly to a human G protein-coupled receptor for which the endogenous ligand is known ("known GPCRs"), and most particularly to mutated (non-endogenous) versions of the known GPCRs for use, most preferably in screening assays for the direct identification of candidate compounds as inverse agonists, agonists and partial agonists.

3 Claims, 7 Drawing Sheets

OTHER PUBLICATIONS

Gantz, I. et al., "Molecular cloning of a novel melanocortin receptor", *J Biol Chem*, 1993, 268(11), pp 8246–8250.

Gerald. C. et al., "A receptor subtype involved in neuropeptide Y induced food intake" *Nature*, 1996, 382, pp 168–171.

Gerard, C.M. et al., "Molecular cloning of a human cannabinoid receptor which is also express in testis", *J. Biochem,*, 1991,279, pp 129–134.

Gundlach, A.L. et al., "Galanin–galanin receptor systems in the hypothalamic paraventricular and supraoptic nuclei", *Ann NY Acad Sci*, 1998, pp 241–247.

Jin, H. et al., "Characterization of the human 5–hydroxytryptamine 1b receptor" *J. Biol Chem*, 1992, 267(9), pp 5735–5738.

Jordan, N.J. et al., "Expression of functional CXCR4 chemokine receptors on human colonic epithelial cells", *J. Clin Invest*, 1999, 104(8), pp1061–1069.

Kenakin, T., 43 *Life Sciences* 1095 (1998).

Kohen, R. et al., "Cloning, characterization and chromosomal localization of a human 5–HT6 serotonin receptor", *J Neurochem*, 1996, 66(1),pp 47–56.

Kolakowki, LF Jr. et al., "Characterization of a human gene related to genes encoding somatostatin receptors", *FEBS Lett*, 1996, 398(2–3), pp 253–258.

Kursar, "Molecular cloning, functional expression and mRNA tissue distribution of the human 5–hydroxytryptamine 2b receptor", *J.D. Mol Pharmacol*,1994, 46, pp 227–234.

Manson, E. et al., "Isolation of a human opioid receptor cDNA from placen", *Biochem Biophys Res Commun*, 1994, 202(3), pp 1431.

Munro. S. et al., "Molecular characterization of a peripheral receptor for cannabinoids"*Nature*, 1993, 365(6441), pp 61–65.

Ogi, K. et al., "Molecular cloning and functional expression cDNA encoding a human pituitary adenylate CY activating polypeptide receptor", *Biochem Biophys Res Commun*, 1993, 196(3), pp1511.

Panetta, R. et al., "Molecular cloning, functional characterization and chromosomal localization of a human somatostatin receptor with preferntial affinity for somatostatin–28", *Mol Pharmacol*, 1994, 45(3), pp 417–427.

Peralta, E.G. et al., "Distinct primry structures, ligand–binding properties and tissue–specific expression of four human muscarinic acetylcholine receptors", *Embo J.* 1987, 6(13), pp 3923–3929.

Perrin. M.H. et al., "Cloning and functional expression of a rat brain corticotropin releasing factor (CRF) receptor", *Endocrinology*, 1993, 133(6), pp 3058–3061.

Raport, C.J. et al., Molecular cloning and functional characterization of anovel human CC chemokine receptor (CCR5) for RANTES, MIP–1§, and MIP–1, *J. Biol Chem*, 1996, 271(29), pp 17161–17166.

Rees, S. et al., "Cloning and characterisation of the human 5–ht 5a serotonin receptor", *Febs Lett*, 1994, 355(3),pp 242–246.

Remington's Pharmaceutical Sciences, 16$^{th}$ edition, 1980, Mack Publishing Co.

Napolitano M. et al., Forum (Geneva)1999, Oct.–Dec.;9(4):315–24.

Nichols, J.G. et al., "Indirect mechanisms of synaptic transmission" Chpt 8, 1992, *From Neuron to Brain*.

Rohrer, L. et al., "Cloning and characterization of a fourth human somatosttin receptor", *Pro Natl Acad Sci USA*, 1993, 90(9), pp 4146–4200.

Sakurai, T. et al., "Orexins and orexin receptors: a family of hypothalamic neuropeptides and g protein coupled receptors that regulate feeding behavior", *Cell*, 1998, 92, pp 573–585.

Schipani, E. et al., "Identical complementary deoxyribonucleic acids encode a human renal and bone prathyrid hormone (PTH)/PTH–related peptide receptor" *Endocrinology*, 1993, 132(5), pp 2157–2165.

Schmaus. C. et al., "Selective loss of dopamine D3–type receptor mRNA expression in parietyal and motor cortices of patients with chronic schizophrenia", *Proc Natl Acad Sci USA*, 1993, 909(19), pp. 8942–8946.

Shan, L. et al., "Identification of viral macrophage inflammatory protein (vMIP)–II as a ligand for GPR5/XCR1", *Biochem Biophys Res Commun*, 2000, 268(3), pp 938–941.

Sreedharan, S.P. et al., "Cloning and functional expression of a human neuroendocrine vasoactive intestinal peptide receptor", *Biochem Biophys Res Commun*, 1993, 193(2),pp 546–553.

Stephan, D. et al.,"Human metabotropic Glutamate receptro 1: m RNA distribution , chromosome localization and functional expression of two splice variants" *Neuropharmacology*, 1996, 35(12), pp 1649–1660.

Sugimoto, T. et al., "Molecuar cloning and functional expression of cDNA encoding the human v1b vasopressin receptor", *J. Biol Chem*, 1994, 269(43),pp 27088–27092.

Sunahara, R.K. et al., Cloning of the gene for a human dopamine D5 receptor with higher affinity for dopamine than D1, *Nature*, 1991, 35(6319), pp 614–619.

Takeda, Y. et al., "Molecular cloning, structural characterization and functional expression of the human substance p receptor", *Biochem Biophys Res Comm*, 1991, 179.

Usdin, T.B. et al., "Identification and functional expression of a receptor selectively recognizing parathyroid hormone, the PTH2 receptor", *J. Biol Chem*, 1995, 270(26), pp 15455–15458.

Vita, N. et al., "Cloning and expression of a complementary DNA encoding a high affinity human neurotensin receptor", *FEBS Lett*, 1993, 17(1–2), pp 139–142.

Watabe, A. et al., "Cloning and expression of cDNA for a mouse EP1 subtype of prostaglandin E receptor", *J. Biol. Chem*, 1993, 268(27), pp 20175–20178.

Weinshank, R.L. et al., Human sertonin 1D receptor is encoded by a subfamily of two distinct genes:5–HT1d and 5–HT 1d§, *Proc Natl Acad Sci USA*, 1992, 89(8), pp 3630–3634.

Wick, M.J. et al., "Differential expression of opioid receptor genes in human lymphoid cell lines and peripheral blood lymphocytes", *J. Neuroimnunol*, 1996, 64(1),pp 29.

Yamada, Y. et al., "Somatostatin receptors, an expanding gene family:cloning and functional characterization of human SSTR3, a protein coupled to adenylyl cyclase" *Mol Endocrinol*, 1992, 6,pp 2136–2142.

Yamada, Y et al., "Cloning and functional characterization of a family of human and mouse somatostatin receptors express in brain, gastrointestinal tract, and kidney", *Proc Natl Acad Sci USA*, 1992, 89, pp 251–255.

Zhang, J. et al., "Expression of the chemokine eotaxin and its receptor, CCR3, in human endometrium", *Biol Reprod*, 2000, 62(2), pp 404–411.

Barr and Manning, "Agonist–Independent activation of Gz by the 5–hydroxytryptamine receptor co–expressed in 5Spodoptera fruglperda cells," J. Biol. Chem. (1997) 272:32979–32987.

Egan et al., "Creation of a constitutively activated state of the 5–HT2A receptor site–deirected mutagenesis: revelation of inverse agonist activity of antagonists," Ann. N.Y. Acad. Sci (1998) 861:136–139.

Pauwels and Wurch, et al, "Review, amino acid domains involved in constitutive activation of G–protein–coupled receptors," Mol. Neurobiol. (1998) 17:109–135.

Lembo and Albert, "Multiple phosphorylation sites are required for pathway–selective uncoupling of the 5–hydroxytryptamine 1A receptor by protein kinase C," Mol. Pharmacol. (1995) 48:1024–1029.

Malmberg and Strange,"Site–directed mutations in the third intracellular loop of the serotonin 5–HT1A receptor altar G protein coupling from Gi to Gs in a ligand–dependent manner," J. Neurobiol. (2000) 75:1283–1293.

Kawanashi, et al., "Novel mutations in the promoter and coding region of the human 5–HT1A receptor gene and association analysis in schizophrenia," Am. J. Med. Genet. (1998) 81:434–439.

International Search Report, PCT/US01/11098, Jul. 10, 2002.

* cited by examiner

NON-ENDOGENOUS, CONSTITUTIVELY ACTIVATED KNOWN G PROTEIN-COUPLED RECEPTORS

This patent application claims priority from U.S. Provisional Application No. 60/195,747, filed with the U.S. Patent and Trademark Office on Apr. 7, 2000, which is incorporated in its entirety by reference.

FIELD OF THE INVENTION

The invention disclosed in this patent document relates to transmembrane receptors, and more particularly to G protein-coupled receptors for which the endogenous ligand has been identified ("known GPCR"), and specifically to known GPCRs that have been altered to establish or enhance constitutive activity of the receptor. Most preferably, the altered GPCRs are used for the direct identification of candidate compounds as receptor agonists, inverse agonists or partial agonists for use as therapeutic agents.

BACKGROUND OF THE INVENTION

Although a number of receptor classes exist in humans, by far the most abundant and therapeutically relevant is represented by the G protein-coupled receptor (GPCR or GPCRs) class. It is estimated that there are some 100,000 genes within the human genome, and of these, approximately 2%, or 2,000 genes, are estimated to code for GPCRs. Receptors, including GPCRs, for which the endogenous ligand has been identified are referred to as "known" receptors, while receptors for which the endogenous ligand has not been identified are referred to as "orphan" receptors. GPCRs represent an important area for the development of pharmaceutical products: from approximately 20 of the 100 known GPCRs, 60% of all prescription pharmaceuticals have been developed.

GPCRs share a common structural motif. (All these receptors have seven sequences of between 22 to 24 hydrophobic amino acids that form seven alpha helices, each of which spans the membrane (each span is identified by number, i.e., transmembrane-1 (TM-1), transmembrane-2 (TM-2), etc.). The transmembrane helices are joined by strands of amino acids between transmembrane-2 and transmembrane-3, transmembrane-4 and transmembrane-5, and transmembrane-6 and transmembrane-7 on the exterior, or "extracellular" side, of the cell membrane (these are referred to as "extracellular" regions 1, 2 and 3 (EC-1, EC-2 and EC-3), respectively). The transmembrane helices are also joined by strands of amino acids between transmembrane-1 and transmembrane-2, transmembrane-3 and transmembrane-4, and transmembrane-5 and transmembrane-6 on the interior, or "intracellular" side, of the cell membrane (these are referred to as "intracellular" regions 1, 2 and 3 (IC-1, IC-2 and IC-3), respectively). The "carboxy" ("C") terminus of the receptor lies in the intracellular space within the cell, and the "amino" ("N") terminus of the receptor lies in the extracellular space outside of the cell.

Generally, when an endogenous ligand binds with the receptor (often referred to as "activation" of the receptor), there is a change in the conformation of the intracellular region that allows for coupling between the intracellular region and an intracellular "G-protein." It has been reported that GPCRs are "promiscuous" with respect to G proteins, i.e., that a GPCR can interact with more than one G protein. See, Kenakin, T., 43 Life Sciences 1095 (1988). Although other G proteins exist, currently, Gq, Gs, Gi, Gz and Go are G proteins that have been identified. Endogenous ligand-activated GPCR coupling with the G-protein begins a signaling cascade process (referred to as "signal transduction"). Under normal conditions, signal transduction ultimately results in cellular activation or cellular inhibition. It is thought that the IC-3 loop as well as the carboxy terminus of the receptor interact with the G protein.

Under physiological conditions, GPCRs exist in the cell membrane in equilibrium between two different conformations: an "inactive" state and an "active" state. A receptor in an inactive state is unable to link to the intracellular signaling transduction pathway to produce a biological response. Changing the receptor conformation to the active state allows linkage to the transduction pathway (via the G-protein) and produces a biological response.

A receptor may be stabilized in an active state by an endogenous ligand or a compound such as a drug. Recent discoveries, including but not exclusively limited to modifications to the amino acid sequence of the receptor, provide means other than endogenous ligands or drugs to promote and stabilize the receptor in the active state conformation. These means effectively stabilize the receptor in an active state by simulating the effect of an endogenous ligand binding to the receptor. Stabilization by such ligand-independent means is termed "constitutive receptor activation."

Traditional ligand-dependent screens seek to indirectly identify compounds that antagonize the action of the ligand on the receptor in an effort to prevent ligand-induced activation of the receptor. However, such compounds, sometimes referred to as neutral-antagonists, generally would not be expected to affect the ligand-independent activity, or overactivity, of the receptor and the subsequent abnormal cellular response that can result from this overactivity. This is particularly relevant to a growing number of diseases, such as those identified in the table below, that have been linked to overactive GPCRs, because traditional neutral-antagonists will not block the abnormal ligand-independent activity of these receptors.

Background Table 1

| Disease | Overactive GPCR |
| --- | --- |
| Schizophrenia | 5-HT2A, D2 |
| Depression | 5-HT2A |
| Hyperthyroidism | Thyrotropin |
| Hypertension | Angiotensin AT1A |
| Asthma | Adenosine A1 |
| Melanoma | MC-1 |
| Retinitis Pigmentosa | Rhodopsin receptor |

SUMMARY OF THE INVENTION

Disclosed herein are non-endogenous versions of endogenous, known GPCRs and uses thereof.

DETAILED DESCRIPTION

Figure 1:
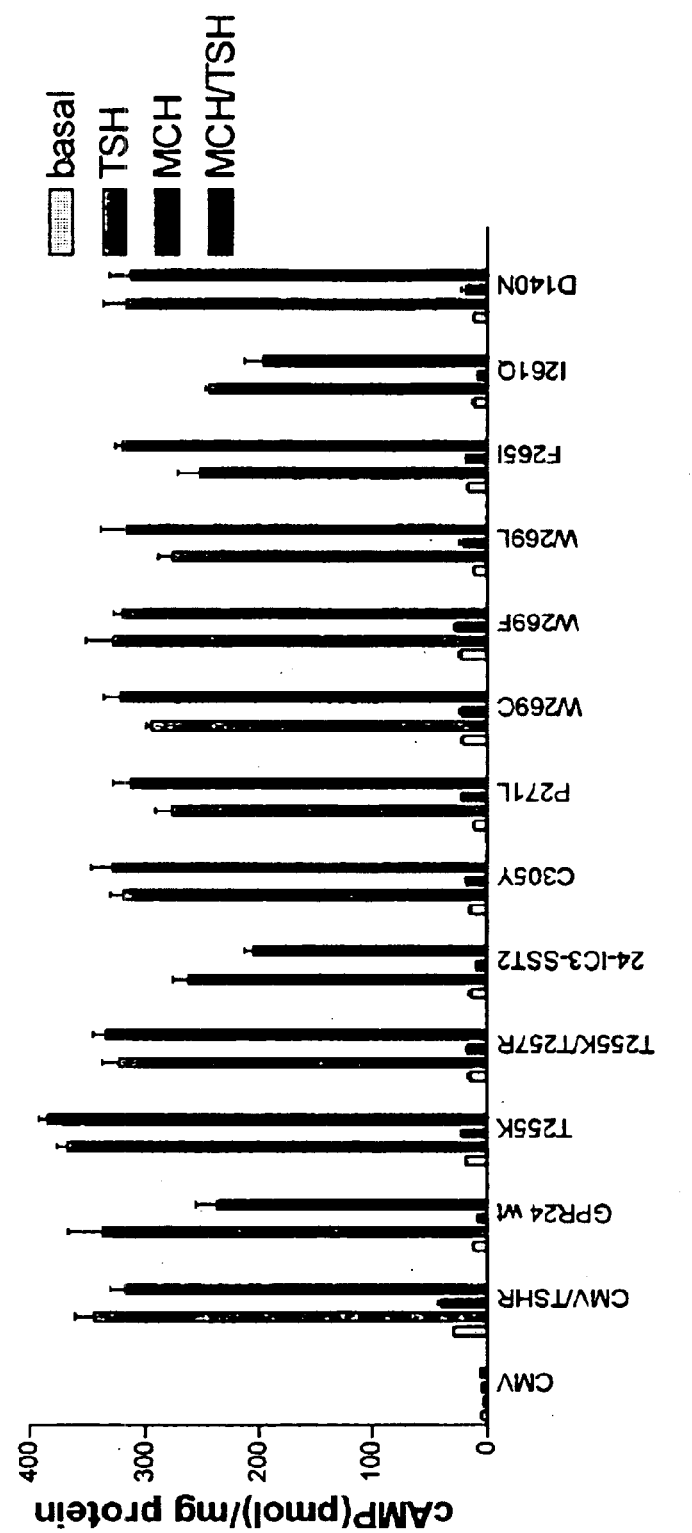
FIG. 1 provides graphic results of comparative analysis of a co-transfection of non-endogenous TSHR-A6231 ("signal enhancer") and an endogenous target receptor, in this case GPR24 ("GPR24 wt"), versus non-endogenous, constitutively activated versions of the target receptor GPR24 ("T255K," "T255K/T257R," "24-IC3-SST2," "C305Y," "P271L," "W269C," "W269F," "W269L," "F265I," I261Q," and "D140N") co-transfected with non-endogenous TSHR-A623I, utilizing an adenylyl cyclase assay. This assay involved the addition of TSH and MCH, the endogenous ligands for TSHR and GPR24, respectively.

The scientific literature that has evolved around receptors has adopted a number of terms to refer to ligands having various effects on receptors. For clarity and consistency, the following definitions will be used throughout this patent document. To the extent that these definitions conflict with other definitions for these terms, the following definitions shall control:

AGONISTS shall mean materials (e.g., ligands, candidate compounds) that activate the intracellular response when they bind to the receptor, or enhance GTP binding to membranes.

AMINO ACID ABBREVIATIONS used herein are set out in Table A:

TABLE A

| ALANINE | ALA | A |
| ARGININE | ARG | R |
| ASPARAGINE | ASN | N |
| ASPARTIC ACID | ASP | D |
| CYSTEINE | CYS | C |
| GLUTAMIC ACID | GLU | E |
| GLUTAMINE | GLN | Q |
| GLYCINE | GLY | G |
| HISTIDINE | HIS | H |
| ISOLEUCINE | ILE | I |
| LEUCINE | LEU | L |
| LYSINE | LYS | K |
| METHIONINE | MET | M |
| PHENYLALANINE | PHE | F |
| PROLINE | PRO | P |
| SERINE | SER | S |
| THREONINE | THR | T |
| TRYPTOPHAN | TRP | W |
| TYROSINE | TYR | Y |
| VALINE | VAL | V |

PARTIAL AGONISTS shall mean materials (e.g., ligands, candidate compounds) that activate the intracellular response when they bind to the receptor to a lesser degree/extent than do agonists, or enhance GTP binding to membranes to a lesser degree/extent than do agonists.

ANTAGONIST shall mean materials (e.g., ligands, candidate compounds) that competitively bind to the receptor at the same site as the agonists but which do not activate the intracellular response initiated by the active form of the receptor, and can thereby inhibit the intracellular responses by agonists or partial agonists. ANTAGONISTS do not diminish the baseline intracellular response in the absence of an agonist or partial agonist.

CANDIDATE COMPOUND, in the context of the disclosed invention, shall mean a small molecule (for example, and not limitation, a chemical compound) that is amenable to a screening technique.

COMPOSITION means a material comprising at least one component; a "pharmaceutical composition" is an example of a composition.

COMPOUND EFFICACY shall mean a measurement of the ability of a compound to inhibit or stimulate receptor functionality, as opposed to receptor binding affinity. Exemplary means of detecting compound efficacy are disclosed in the Example section of this patent document.

CODON shall mean a grouping of three nucleotides (or equivalents to nucleotides) which generally comprise a nucleoside (adenosine (A), guanosine (G), cytidine (C), uridine (U) and thymidine (T)) coupled to a phosphate group and which, when translated, encodes an amino acid.

CONSTITUTIVELY ACTIVATED RECEPTOR shall mean a receptor subject to constitutive receptor activation. A constitutively activated receptor can be endogenous or non-endogenous.

CONSTITUTIVE RECEPTOR ACTIVATION shall mean stabilization of a receptor in the active state by means other than binding of the receptor with its endogenous ligand or a chemical equivalent thereof.

CONTACT or CONTACTING shall mean bringing at least two moieties together, whether in an in vitro system or an in vivo system.

DIRECTLY IDENTIFYING or DIRECTLY IDENTIFIED, in relationship to the phrase "candidate compound", shall mean the screening of an candidate compound against a constitutively activated receptor, preferably a constitutively activated receptor, and most preferably against a constitutively activated G protein-coupled cell surface receptor, and assessing the compound efficacy of such compound. This phrase is, under no circumstances, to be interpreted or understood to be encompassed by or to encompass the phrase "indirectly identifying" or "indirectly identified."

ENDOGENOUS shall mean a material that a mammal naturally produces. ENDOGENOUS in reference to, for example and not limitation, the term "receptor," shall mean that which is naturally produced by a mammal (for example, and not limitation, a human) or a virus. By contrast, the term NON-ENDOGENOUS in this context shall mean that which is not naturally produced by a mammal (for example, and not limitation, a human) or a virus. For example, and not limitation, a receptor which is not constitutively active in its endogenous form, but when manipulated becomes constitutively active, is most preferably referred to herein as a "non-endogenous, constitutively activated receptor." Both terms can be utilized to describe both "in vivo" and "in vitro" systems. For example, and not limitation, in a screening approach, the endogenous or non-endogenous receptor may be in reference to an in vitro screening system. As a further example and not limitation, where the genome of a mammal has been manipulated to include a non-endogenous constitutively activated receptor, screening of a candidate compound by means of an in vivo system is viable.

G PROTEIN COUPLED RECEPTOR FUSION PROTEIN and GPCR FUSION PROTEIN, in the context of the invention disclosed herein, each mean a non-endogenous protein comprising an endogenous, constitutively activate GPCR or a non-endogenous, constitutively activated GPCR fused to at least one G protein, most preferably the alpha (α) subunit of such G protein (this being the subunit that binds GTP), with the G protein preferably being of the same type as the G protein that naturally couples with endogenous GPCR. For example, and not limitation, in an endogenous state, if the G protein "Gsα" is the predominate G protein that couples with the GPCR, a GPCR Fusion Protein based upon the specific GPCR would be a non-endogenous protein comprising the GPCR fused to Gsα; in some circumstances, as will be set forth below, a non-predominant G protein can be fused to the GPCR. The G protein can be fused directly to the c-terminus of the constitutively active GPCR or there may be spacers between the two.

HOST CELL shall mean a cell capable of having a Plasmid and/or Vector incorporated therein. In the case of a prokaryotic Host Cell, a Plasmid is typically replicated as a autonomous molecule as the Host Cell replicates (generally, the Plasmid is thereafter isolated for introduction into a eukaryotic Host Cell); in the case of a eukaryotic Host Cell, a Plasmid is integrated into the cellular DNA of the Host Cell such that when the eukaryotic Host Cell replicates, the Plasmid replicates. Preferably, for the purposes of the invention disclosed herein, the Host Cell is eukaryotic, more preferably, mammalian, and most preferably selected from the group consisting of Hek-293, Hek-293T and COS-7 cells.

INDIRECTLY IDENTIFYING or INDIRECTLY IDENTIFIED means the traditional approach to the drug discovery process involving identification of an endogenous ligand specific for an endogenous receptor, screening of candidate compounds against the receptor for determination of those which interfere and/or compete with the ligand-receptor interaction, and assessing the efficacy of the compound for affecting at least one second messenger pathway associated with the activated receptor.

INHIBIT or INHIBITING, in relationship to the term "response" shall mean that a response is decreased or prevented in the presence of a compound as opposed to in the absence of the compound.

INVERSE AGONISTS shall mean materials (e.g., ligand, candidate compounds) which bind to either the endogenous form of the receptor or to the constitutively activated form of the receptor, and which inhibit the baseline intracellular response initiated by the active form of the receptor below the normal base level of activity which is observed in the absence of agonists or partial agonists, or decrease GTP binding to membranes. Preferably, the baseline intracellular response is inhibited in the presence of the inverse agonist by at least 30%, more preferably by at least 50%, and most preferably by at least 75%, as compared with the baseline response in the absence of the inverse agonist.

KNOWN RECEPTOR shall mean an endogenous receptor for which the endogenous ligand specific for that receptor has been identified.

LIGAND shall mean an endogenous, naturally occurring molecule specific for an endogenous, naturally occurring receptor.

MUTANT or MUTATION in reference to an endogenous receptor's nucleic acid and/or amino acid sequence shall mean a specified change or changes to such endogenous sequences such that a mutated form of an endogenous, non-constitutively activated receptor evidences constitutive activation of the receptor. In terms of equivalents to specific sequences, a subsequent mutated form of a human receptor is considered to be equivalent to a first mutation of the human receptor if (a) the level of constitutive activation of the subsequent mutated form of a human receptor is substantially the same as that evidenced by the first mutation of the receptor; and (b) the percent sequence (amino acid and/or nucleic acid) homology between the subsequent mutated form of the receptor and the first mutation of the receptor is at least about 80%, more preferably at least about 90% and most preferably at least 95%. Ideally, and owing to the fact that the most preferred cassettes disclosed herein for achieving constitutive activation includes a single amino acid and/or codon change between the endogenous and the non-endogenous forms of the GPCR, the percent sequence homology should be at least 98%.

NON-ORPHAN RECEPTOR shall mean an endogenous naturally occurring molecule specific for an endogenous naturally occurring ligand wherein the binding of a ligand to a receptor activates an intracellular signaling pathway.

ORPHAN RECEPTOR shall mean an endogenous receptor for which the endogenous ligand specific for that receptor has not been identified or is not known.

PHARMACEUTICAL COMPOSITION shall mean a composition comprising at least one active ingredient, whereby the composition is amenable to investigation for a specified, efficacious outcome in a mammal (for example, and not limitation, a human). Those of ordinary skill in the art will understand and appreciate the techniques appropriate for determining whether an active ingredient has a desired efficacious outcome based upon the needs of the artisan.

PLASMID shall mean the combination of a Vector and cDNA. Generally, a Plasmid is introduced into a Host Cell for the purposes of replication and/or expression of the cDNA as a protein.

STIMULATE or STIMULATING, in relationship to the term "response" shall mean that a response is increased in the presence of a compound as opposed to in the absence of the compound.

VECTOR in reference to cDNA shall mean a circular DNA capable of incorporating at least one cDNA and capable of incorporation into a Host Cell.

The order of the following sections is set forth for presentational efficiency and is not intended, nor should be construed, as a limitation on the disclosure or the claims to follow.

A. Introduction

Constitutively active forms of known G protein-coupled receptors, disclosed in the present patent document, can be obtained by site-directed mutational methods, well-known to those skilled in the art. A constitutively active receptor useful for direct identification of candidate compounds is preferably achieved by mutating the receptor at a specific location within an intracellular loop, most preferably within the intracellular loop three (IC3) region. Such mutation can produce a non-endogenous receptor that is intended to be constitutively activated, as evidenced by an increase in the functional activity of the receptor, for example, an increase in the level of second messenger activity. While standard methods of site-directed mutagenesis may be employed, a preferred method is one that is disclosed in a co-pending, commonly assigned patent document U.S. application Ser. No. 09/170,496, filed Oct. 13, 1998 which is incorporated herein by reference.

Table B below lists known endogenous GPCRs that have been converted to non-endogenous versions thereof, their respective G protein and endogenous ligand.

TABLE B

| Known GPCRs | G Protein | Endogenous Ligand |
|---|---|---|
| 5HT-1A | Gi | Serotonin |
| 5HT-1B | Gi | Serotonin |
| 5HT-1D | Gi | Serotonin |
| 5HT-1E | Gi | Serotonin |
| 5HT-1F | Gi | Serotonin |
| 5HT-2B | Gi | Serotonin |
| 5HT-4A | N/I | Serotonin |
| 5HT-4B | N/I | Serotonin |
| 5HT-4C | N/I | Serotonin |
| 5HT-4D | N/I | Serotonin |
| 5HT-4E | N/I | Serotonin |
| 5HT-5A | Unknown | Serotonin |
| 5HT-6 | Gs | Serotonin |
| 5HT-7 | Gs | Serotonin |
| AVPR1A | Gq | Arginine Vasopressin |
| AVPR1B | Gq | Arginine Vasopressin |
| AVPR2 | Gs | Arginine Vasopressin |
| BBR3 | Gq | Bombesin |
| BDKR1 | Gq | Bradykinin |
| BDKR2 | Gq | Bradykinin |
| C3a | N/I | Anaphylatoxin |
| C5a | N/I | Anaphylatoxin |
| CB1 | Gi | Cannabinoid |
| CB2 | Gi | Cannabinoid |
| CCR2b | Gi | Monocyte chemoattractant (MCP) |
| CCR3 | Gi | Eotaxin, Leukotactin-1, RANTES, MCP |
| CCR5 | Gi | MIP-1α, MIP-1β, RANTES |
| CCR8 | Gi | I-309, TARC, MIP-1β |
| CCR9 | N/I | Thymus-expressed chemokine (TECK) |
| CRFR1 | Gs | Corticotropin-releasing-factor |
| CXCR4 | Gi | SDF1 |
| Dopamine D1 | Gs | Dopamine |
| Dopamine D2 | Gi | Dopamine |
| Dopamine D3 | Gi | Dopamine |
| Dopamine D5 | Gs | Dopamine |
| ETA | Gq | Endothelin |
| ETB | Gq | Endothelin |
| FPR1 | N/I | Formylpeptide |
| FPRL1 | N/I | formylpeptide |
| GALR1 | Gi | Galanin |
| GALR2 | Gi/Gq | Galanin |
| GIP | N/I | Gastric inhibitory polypeptide |
| mGluR1 | Gq | Glutamate |
| GPR5 | N/I | Single C motif-1 (SMC-1) |
| GPR24 (also known as MCH or SLC-1) | Gi/Gq | Melanin Concentrating Hormone |
| GRPR | Gq | Gastrin releasing peptide |
| M1 | Gq | Acetylcholine |
| M2 | Gi | Acetylcholine |
| M3 | Gq | Acetylcholine |
| M4 | Gi | Acetylcholine |
| M5 | Gq | Acetylcholine |
| MC3 | Gs | Melanocortin |
| NK1R | Gq | Substance P |
| NK2R | Gq | Neurokinin-A |
| NK3R | Gq | Neurokinin-B |
| NMBR | Gq | Neuromedin B |
| NPY5 | Gi | Neuropeptide Y |
| NTSR1 | Gq | Neurotensin |
| NTSR2 | Gq | Neurotensin |
| OPRD | Gi | Opiod |
| OPRL1 | Gi | Opiod |
| OPRK | Gi | Opiod |
| OPRM | Gi | Opiod |
| OPRM1A | Gi | Opiod |
| $OX_1R$ | N/I | Orexin |
| $OX_2R$ | N/I | Orexin |
| PACAP | Gs | Pituitary adenylyl cyclase activating peptide |

TABLE B-continued

| Known GPCRs | G Protein | Endogenous Ligand |
|---|---|---|
| PAF | N/I | Platelet activating factor |
| PGE EP1 | N/I | Prostaglandin |
| PGE EP2 | Gs | Prostaglandin |
| PGE EP4 | N/I | Prostaglandin |
| PTHR1 | N/I | Parathyroid hormone |
| PTHR2 | N/I | Parathyroid hormone |
| SCTR | Gs | Secretin |
| SST1 | Gi | Somatostatin |
| SST2 | Gi | Somatostatin |
| SST3 | Gi | Somatostatin |
| SST4 | Gi | Somatostatin |
| SST5 | Gi | Somatostatin |
| TSHR | Gs | Thyroid Stimulating Hormone |
| VIPR | Gs | Vasoactive Intestinal Peptide |
| VIPR2 | Gs | Vasoactive Intestinal Peptide |

Note:
N/I means not indicated

B. Receptor Screening

Screening candidate compounds against a non-endogenous, constitutively activated version of the known GPCRs disclosed herein allows for the direct identification of candidate compounds which act at the cell surface of the receptor, without requiring use of the receptor's endogenous ligand. By determining areas within the body where the endogenous version of known GPCRs disclosed herein is expressed and/or over-expressed, it is possible to determine related disease/disorder states which are associated with the expression and/or over-expression of the receptor; such an approach is disclosed in this patent document.

Table C below lists the known GPCRs and tissues within the body are expressed and/or over-expressed. The listed references provide support for such tissue expression.

TABLE C

| Known GPCRs | Location of Expression | Reference |
|---|---|---|
| 5HT-1A | N/I | N/I |
| 5HT-1B | Striatum | Jin, H. et al., 267(9) J Biol Chem 5735 (1992) |
| 5HT-1D | Cerebral cortex | Weinshank, R. L. et al., 89(8) Proc Natl Acad Sci USA 3630 (1992) |
| 5HT-1E | N/I | N/I |
| 5HT-1F | Brain | Adham, N. et al., 90 Proc Natl Acad Sci USA 408 (1993) |
| 5HT-2B | Various tissues, including Brain | Kursar, J. D., 46(2_Mol Pharmacol 227 (1994) |
| 5HT-4A | Brain, Intestine and Atrium | Blondel, O. et al., 70 J Nerochem 2252 (1998) |
| 5HT-4B | Brain, Intestine and Atrium | Blondel, O. et al., 70 J Nerochem 2252 (1998) |
| 5HT-4C | Brain, Intestine and Atrium | Blondel, O. et al., 70 J Nerochem 2252 (1998) |
| 5HT-4D | Intestine | Blondel, O. et al., 70 J Neurochem 2252 (1998) |
| 5HT-4E | Brain | Claeysen, S. et al., 55(5) Mol Pharmacol 910 (1999) |
| 5HT-5A | Brain | Rees, S. et al., 355(3) FEBS Lett 242 (1994) |
| 5HT-6 | Caudate Nucleus | Kohen, R. et al., 66(1) J Neurochem 47 (1996) |
| 5HT-7 | Brain, Coronary artery | Bard, J. A. et al., 268(31) J Biol Chem 23422 (1993) |
| AVPR1A | N/I | N/I |

TABLE C-continued

| Known GPCRs | Location of Expression | Reference |
|---|---|---|
| AVPR1B | Pituitary | Sugimoto, T. et al., 269(43) J. Biol. Chem 27088 (1994) |
| AVPR2 | Lung, Kidney | Fay, M. J., et al., 17(3) Peptides 477 (1996) |
| BBR3 | Testis, Lung carcinoma | Fathi, Z. et al., 268(8) J. Biol. Chem. 5979 (1993) |
| BDKR1 | N/I | N/I |
| BDKR2 | N/I | N/I |
| C3a | Lung, Spleen, Ovary, Placenta, Small Intestine and Brain | Ames, R. et al., 271(34) J. Biol. Chem 20231(1996) |
| C5a | N/I | N/I |
| CB1 | Brain | Gerard, C. M. et al., 279 Biochem J. 129 (1991) |
| CB2 | Spleen, Macrophage | Munro, S. et al., 365(6441) Nature 61 (1993) |
| CCR2b | N/I | N/I |
| CCR3 | Endometrium | Zhang, J. et al., 62(2) Biol Reprod 404 (2000) |
| CCR5 | Thymus, Spleen | Raport, C. J. et al., 271(29) J Biol Chem 17161 (1996) |
| CCR8 | Thymus, Spleen and Lymph nodes | Napolitano M. et al., Forum (Geneva) 1999 Oct–Dec;9(4):315–24 |
| CCR9 | Thymus | Zaballos, A. et al., 162(10) J. Immunol 5671 (1999) |
| CRFR1 | Brain, Pituitary | Perrin, M. H. et al., 133(6) Endocrinology 3058 (1993) |
| CXCR4 | Colonic epithelial cells | Jordan, N. J. et al., 104(8) J Clin Invest 1061 (1999) |
| Dopamine D1 | Caudate, Nucleus accumbens and Olfactory tubercle | Dearry, A. et al., 347 Nature 72 (1990) |
| Dopamine D2 | Retina | Dearry, A. et al., 11(5) Cell Mol. Neurobiol. 437 (1991) |
| Dopamine D3 | Brain | Schmauss, C. et al., 90(19) Proc Natl Acad Sci USA 8942 (1993) |
| Dopamine D5 | Brain | Sunahara, R. K. et al., 350(6319) Nature 614 (1991) |
| ETA | Placenta, Uterus, Testis, Adrenal gland | Adachi, M. et al., 180(3) Biochem Biophys Res Commun 1265 (1991) |
| ETB | N/I | N/I |
| FPR1 | N/I | N/I |
| FPRL1 | N/I | N/I |
| GALR1 | Hypothalamic paraventricular, Supraoptic nuclei | Gundlach, A. L. et al., 863 Ann NY Acad Sci 241 (1998) |
| GALR2 | Hypothalamus, Hippocampus, Anterior pituitary | Fathi, Z. et al., 51 Brain Res Mol Brain Res 49 (1997) |
| GIP | N/I | N/I |
| mGluR1 | Brain | Stephan, D. et al., 35(12) Neuropharmacology 1649 (1996) |
| GPR5 | Leukocyte cells | Shan, L. et al., 268(3) Biochem Biophys Res Commun 938 (2000) |
| GPR24 (also known as MCH or SLC-1) | Fore-brain, Hypothalamus | Kolakowki L F Jr. et al., 398(2–3) FEBS Lett 253 (1996) |
| GRPR | Lung carcinoma cells | Corjay, M. H. et al., 266 Jo Biol Chem 18771 (1991) |
| M1 | Heart, Pancreas and Neuronal cell lines | Peralta, E. G. et al., Embo J. 6(13) 3923 (1987) |
| M2 | Heart, Pancreas and Neuronal cell lines | Peralta, E. G. et al., Embo J. 6(13) 3923 (1987) |
| M3 | Heart, Pancreas and Neuronal cell lines | Peralta, E. G. et al., Embo J. 6(13) 3923 (1987) |
| M4 | Heart, Pancreas and Neuronal cell lines | Peralta, E. G. et al., Embo J. 6(13) 3923 (1987) |
| M5 | Brain | Bonner, T. I. et al., Neuron 1(5), 403 (1988) |

TABLE C-continued

| Known GPCRs | Location of Expression | Reference |
|---|---|---|
| MC3 | Brain, Placenta, Gut | Gantz I. et al., 268(11) Jo Biol Chem 8246 (1993) |
| NK1R | Spinal cord, Lung | Taked, Y. et aL, 179(3) Biochem Biophys Res Commun 1232(1991) |
| NK2R | N/I | N/I |
| NK3R | N/I | N/I |
| NMBR | Lung carcinoma cells | Corjay, M. H. et al., 266 Jo Biol Chem 18771 (1991) |
| NPY5 | Hypothalamus | Gerald, C. et al., 382 Nature 168 (1996) |
| NTSR1 | Brain, Small intestine | Vita, N. et al., 17 (1–2) FEBS Lett 139 (1993) |
| NTSR2 | N/I | N/I |
| OPRD | Peripheral blood lymphocytes | Wick, M. J. et al., 64(1) J. Neuroimmunol 29 (1996) |
| OPRL1 | N/I | N/I |
| OPRK | Placenta, Brain | Manson, E. et al., 202(3) Biochem Biophys Res Commun 1431 (1994) |
| OPRM | N/I | N/I |
| OPRM1A | N/I | N/I |
| $OX_1R$ | Hypothalamus | Sakurai T. et al., 92 Cell 573 (1998) |
| $OX_2R$ | Hypothalamus | Sakurai T. et al., 92 Cell 573 (1998) |
| PACAP | Brain | Ogi, K. et al., 196(3) Biochem Biophys Res Commun 1511 (1993) |
| PAF | N/I | N/I |
| PGE EP1 | Kidney | Watabe, A. et al., 268(27) J Biol Chem 20175 (1993) |
| PGE EP2 | Small Intestine | Bastien, L. et al., 269(16) J. Biol. Chem 11873 (1994) |
| PGE EP4 | N/I | N/I |
| PTHR1 | Bone, Kidney | Schipani, E. et al., 132(5) Endocrinology 2157 (1993) |
| PTHR2 | Brain, Pancreas | Usdin, T. B. et al., 270(26) J. Biol Chem 15455 (1995) |
| SCTR | Pancreas, Intestine | Chow, B. K., 212(1) Biochem Biophys Res Commun 204 (1995) |
| SST1 | Jejunum, Stomach | Yamada Y. et al., 89 Proc Natl Acad Sci USA 251 (1992) |
| SST2 | Cerebrum, Kidney | Yamada Y. et al., 89 Proc Natl Acad Sci USA 251 (1992) |
| SST3 | Brain, Pancreatic islet | Yamada Y. et al., 6 Mol Endocrinol 2136 (1992) |
| SST4 | Fetal, Adult Brain, Lung | Rohser L. et al., 90(9) Pro Natl Acad Sci USA 4146 (1993) |
| SST5 | Pituitary | Panetta R. et al., 45(3) mol Pharmacol 417 (1994) |
| TSHR | Retro-orbital tissues, Exophthalmos | Feliciello A. et al 342 Lancet 337 (1993) |
| VIPR | Lung | Sreedharan, S. P. et al., 193(2) Biochem Biophys Res Commun 546 (1993) |
| VIPR2 | Skeletal muscle | Adamou, J. E. et al., 209(2) Biochem Biophys Res Commun 385 (1995) |

Note:
N/I means not indicated

Creation of a non-endogenous version of a known GPCR that may evidence constitutive activity is most preferably based upon the distance from a proline residue located within TM6 of the GPCR; this technique is disclosed in co-pending and commonly assigned patent document U.S. Ser. No. 09/170,496, incorporated herein by reference. This technique is not predicated upon traditional sequence "alignment" but rather a specified distance from the aforementioned TM6 proline residue. By mutating the amino acid residue located 16 amino acid residues from this residue (presumably located in the IC3 region of the receptor) to, most preferably, a lysine residue, such activation may be obtained. Other amino acid residues may be used for the mutation, but lysine is most preferred.

D. Disease/Disorder Identification and/or Selection

As will be set forth in greater detail below, most preferably inverse agonists, partial agonists and agonists in the form of small molecule chemical compounds to the non-endogenous, constitutively activated GPCR can be identified by the methodologies of this invention. Such compounds are ideal candidates as lead modulators in drug discovery programs for treating diseases or disorders associated with a particular receptor. The ability to directly identify such compounds to the GPCR, in the absence of use of the receptor's endogenous ligand, allows for the development of pharmaceutical compositions.

Preferably, in situations where it is unclear what disease or disorder may be associated with a receptor; the DNA sequence of the known GPCR is used to make a probe for (a) dot-blot analysis against tissue-mRNA, and/or (b) RT-PCR identification of the expression of the receptor in tissue samples. The presence of a receptor in a tissue source, or a diseased tissue, or the presence of the receptor at elevated concentrations in diseased tissue compared to a normal tissue, can be preferably utilized to identify a correlation with a treatment regimen, including but not limited to, a disease associated with that disease. Receptors can equally well be localized to regions of organs by this technique. Based on the known functions of the specific tissues to which the receptor is localized, the putative functional role of the receptor can be deduced.

E. Screening of Candidate Compounds

1. Generic GPCR Screening Assay Techniques

When a G protein receptor becomes constitutively active, it binds to a G protein (e.g., Gq, Gs, Gi, Gz, Go) and stimulates the binding of GTP to the G protein. The G protein then acts as a GTPase and slowly hydrolyzes the GTP to GDP, whereby the receptor, under normal conditions, becomes deactivated. However, constitutively activated receptors continue to exchange GDP to GTP. A non-hydrolyzable analog of GTP, [$^{35}$S]GTPγS, can be used to monitor enhanced binding to membranes which express constitutively activated receptors. It is reported that [$^{35}$S]GTPγS can be used to monitor G protein coupling to membranes in the absence and presence of ligand. An example of this monitoring, among other examples well-known and available to those in the art, was reported by Traynor and Nahorski in 1995. The preferred use of this assay system is for initial screening of candidate compounds because the system is generically applicable to all G protein-coupled receptors regardless of the particular G protein that interacts with the intracellular domain of the receptor.

2. Specific GPCR Screening Assay Techniques

Once candidate compounds are identified using the "generic" G protein-coupled receptor assay (i.e., an assay to select compounds that are agonists, partial agonists, or inverse agonists), further screening to confirm that the compounds have interacted at the receptor site is preferred. For example, a compound identified by the "generic" assay may not bind to the receptor, but may instead merely "uncouple" the G protein from the intracellular domain.

a. Gs, Gz and Gi.

Gs stimulates the enzyme adenylyl cyclase. Gi (and Gz and Go), on the other hand, inhibit this enzyme. Adenylyl cyclase catalyzes the conversion of ATP to cAMP; thus, constitutively activated GPCRs that couple the Gs protein are associated with increased cellular levels of cAMP. On the other hand, constitutively activated GPCRs that couple Gi (or Gz, Go) protein are associated with decreased cellular levels of cAMP. See, generally, "Indirect Mechanisms of Synaptic Transmission," Chpt. 8, *From Neuron To Brain* (3$^{rd}$ Ed.) Nichols, J. G. et al eds. Sinauer Associates, Inc. (1992). Thus, assays that detect cAMP can be utilized to determine if a candidate compound is, e.g., an inverse agonist to the receptor (i.e., such a compound would decrease the levels of cAMP). A variety of approaches known in the art for measuring cAMP can be utilized; a most preferred approach relies upon the use of anti-cAMP antibodies in an ELISA-based format. Another type of assay that can be utilized is a second messenger reporter system assay. Promoters on genes drive the expression of the proteins that a particular gene encodes. Cyclic AMP drives gene expression by promoting the binding of a cAMP-responsive DNA binding protein or transcription factor (CREB) that then binds to the promoter at specific sites called cAMP response elements and drives the expression of the gene. Reporter systems can be constructed which have a promoter containing multiple cAMP response elements before the reporter gene, e.g., β-galactosidase or luciferase. Thus, a constitutively activated Gs-linked receptor causes the accumulation of cAMP that then activates the gene and expression of the reporter protein. The reporter protein such as β-galactosidase or luciferase can then be detected using standard biochemical assays (Chen et al. 1995).

b. Go and Gq.

Gq and Go are associated with activation of the enzyme phospholipase C, which in turn hydrolyzes the phospholipid PIP$_2$, releasing two intracellular messengers: diacycloglycerol (DAG) and inistol 1,4,5-triphoisphate (IP$_3$). Increased accumulation of PP$_3$ is associated with activation of Gq- and Go-associated receptors. See, generally, "Indirect Mechanisms of Synaptic Transmission," Chpt. 8, *From Neuron To Brain* (3$^{rd}$ Ed.) Nichols, J. G. et al eds. Sinauer Associates, Inc. (1992). Assays that detect IP$_3$ accumulation can be utilized to determine if an candidate compound is, e.g., an inverse agonist to a Gq- or Go-associated receptor (i.e., such a compound would decrease the levels of IP$_3$). Gq-associated receptors can also be examined using an AP1 reporter assay in that Gq-dependent phospholipase C causes activation of genes containing AP1 elements; thus, activated Gq-associated receptors will evidence an increase in the expression of such genes, whereby inverse agonists thereto will evidence a decrease in such expression, and agonists will evidence an increase in such expression. Commercially available assays for such detection are available.

3. Ligand-Based Confirmation Assays

The candidate compounds directly identified using the techniques (or equivalent techniques) above are then, most preferably, verified using a ligand-based verification assay, such as the one set forth in the protocol of Example 8. The importance here is that the candidate compound be directly identified; subsequent confirmation, if any, using the endogenous ligand, is merely to confirm that the directly identified candidate compound has targeted the receptor.

For example, sumatriptan is a well-known agonist of the 5-HT1B and 5-HT1D receptors, while naltrindole is a well-known antagonist to the OPMID receptor. Accordingly, an agonist (sumatriptan) and/or antagonist (naltrindole) competitive binding assay(s) can be used to confirm that those candidate compounds directly identified using a ligand independent screening technique comprising non-endogenous, constitutively activated 5-HT1B or 5-HT1D, and non-endogenous constitutively activated OPM1D, respectfully, may be used for confirmatory purposes. Those skilled in the art are credited with the ability to select techniques for ligand-based confirmation assays.

4. GPCR Fusion Protein

The use of a non-endogenous, constitutively activated GPCR, for use in screening of candidate compounds for the direct identification of inverse agonists, agonists and partial agonists, provides an interesting screening challenge in that, by definition, the receptor is active even in the absence of an endogenous ligand bound thereto. Thus, in order to differentiate between, e.g., the non-endogenous receptor in the presence of a candidate compound and the non-endogenous receptor in the absence of that compound, with an aim of such a differentiation to allow for an understanding as to whether such compound may be an inverse agonist, agonist, partial agonist or has no affect on such a receptor, it is preferred that an approach be utilized that can enhance such differentiation. A preferred approach is the use of a GPCR Fusion Protein.

Generally, once it is determined that a non-endogenous GPCR has been constitutively activated using the assay techniques set forth above (as well as others), it is possible to determine the predominant G protein that couples with the endogenous GPCR. Coupling of the G protein to the GPCR provides a signaling pathway that can be assessed. Because it is most preferred that screening take place by use of a mammalian expression system, such a system will be expected to have endogenous G protein therein. Thus, by definition, in such a system, the non-endogenous, constitutively activated GPCR will continuously signal. In this regard, it is preferred that this signal be enhanced such that in the presence of, e.g., an inverse agonist to the receptor, it is more likely that it will be able to more readily differentiate, particularly in the context of screening, between the receptor when it is contacted with the inverse agonist.

The GPCR Fusion Protein is intended to enhance the efficacy of G protein coupling with the non-endogenous GPCR. The GPCR Fusion Protein is preferred for screening with a non-endogenous, constitutively activated GPCR because such an approach increases the signal that is most preferably utilized in such screening techniques. This is important in facilitating a significant "signal to noise" ratio; such a significant ratio is preferred for the screening of candidate compounds as disclosed herein.

The construction of a construct useful for expression of a GPCR Fusion Protein is within the purview of those having ordinary skill in the art. Commercially available expression vectors and systems offer a variety of approaches that can fit the particular needs of an investigator. The criteria of importance for such a GPCR Fusion Protein construct is that the endogenous GPCR sequence and the G protein sequence both be in-frame (preferably, the sequence for the endogenous GPCR is upstream of the G protein sequence) and that the "stop" codon of the GPCR must be deleted or replaced such that upon expression of the GPCR, the G protein can also be expressed. The GPCR can be linked directly to the G protein, or there can be spacer residues between the two (preferably, no more than about 12, although this number can be readily ascertained by one of ordinary skill in the art). Use of a spacer is preferred (based upon convenience) in that some restriction sites that are not used will, effectively, upon expression, become a spacer. Most preferably, the G protein that couples to the non-endogenous GPCR will have been identified prior to the creation of the GPCR Fusion Protein construct. Because there are only a few G proteins that have been identified, it is preferred that a construct comprising the sequence of the G protein (i.e., a universal G protein construct) be available for insertion of an endogenous GPCR sequence therein; this provides for efficiency in the context of large-scale screening of a variety of different endogenous GPCRs having different sequences.

F. Co-Transfection of a Target Gi Coupled GPCR with a Signal-Enhancer Gs Coupled GPCR (cAMP Based Assays)

A Gi coupled receptor is known to inhibit adenylyl cyclase, and, therefore, decrease the level of cAMP production, which can make assessment of cAMP levels challenging. An effective technique in measuring the decrease in production of cAMP as an indication of constitutive activation of a receptor that predominantly couples Gi upon activation can be accomplished by co-transfecting a signal enhancer, e.g., a non-endogenous, constitutively activated receptor that predominantly couples with Gs upon activation (e.g., TSHR-A623I, disclosed below), with the Gi linked GPCR (such a technique is exemplified herein with the Gi coupled receptor, GPR24). As is apparent, constitutive activation of a Gs coupled receptor can be determined based upon an increase in production of cAMP. Constitutive activation of a Gi coupled receptor leads to a decrease in production cAMP. Thus, the co-transfection approach is intended to advantageously exploit these "opposite" affects. For example, co-transfection of a non-endogenous, constitutively activated Gs coupled receptor (the "signal enhancer") with the endogenous Gi coupled receptor (the "target receptor") provides a baseline cAMP signal (i.e., although the Gi coupled receptor will decrease cAMP levels, this "decrease" will be relative to the substantial increase in cAMP levels established by constitutively activated Gs coupled signal enhancer). By then co-transfecting the signal enhancer with a constitutively activated version of the target receptor, cAMP would be expected to further decrease (relative to base line) due to the increased functional activity of the Gi target (i.e., which decreases cAMP).

Screening of candidate compounds using a cAMP based assay can then be accomplished, with two provisos: first, relative to the Gi coupled target receptor, "opposite" effects will result, i.e., an inverse agonist of the Gi coupled target receptor will increase the measured cAMP signal, while an agonist of the Gi coupled target receptor will decrease this signal; second, as would be apparent, candidate compounds that are directly identified using this approach should be assessed independently to ensure that these do not target the signal enhancing receptor (this can be done prior to or after screening against the co-transfected receptors).

G. Medicinal Chemistry

Generally, but not always, direct identification of candidate compounds is preferably conducted in conjunction with compounds generated via combinatorial chemistry techniques, whereby thousands of compounds are randomly prepared for such analysis. Generally, the results of such screening will be compounds having unique core structures; thereafter, these compounds are preferably subjected to additional chemical modification around a preferred core structure(s) to further enhance the medicinal properties thereof. Such techniques are known to those in the art and will not be addressed in detail in this patent document.

H. Pharmaceutical Compositions

Candidate compounds selected for further development can be formulated into pharmaceutical compositions using techniques well known to those in the art. Suitable pharmaceutically-acceptable carriers are available to those in the art; for example, see Remington's Pharmaceutical Sciences, $16^{th}$ Edition, 1980, Mack Publishing Co., (Oslo et al., eds.).

I. Other Utility

Although a preferred use of the non-endogenous version of the known GPCRs disclosed herein may be for the direct identification of candidate compounds as inverse agonists, agonists or partial agonists (preferably for use as pharmaceutical agents), these versions of known GPCRs can also be utilized in research settings. For example, in vitro and in vivo systems incorporating GPCRs can be utilized to further elucidate and better understand the roles these receptors play in the human condition, both normal and diseased, as well as understanding the role of constitutive activation as it applies to understanding the signaling cascade. The value in non-endogenous known GPCRs is that their utility as a research tool is enhanced in that, because of their unique features, non-endogenous known GPCRs can be used to understand the role of these receptors in the human body before the endogenous ligand therefor is identified. Other uses of the disclosed receptors will become apparent to those in the art based upon, inter alia, a review of this patent document.

EXAMPLES

The following examples are presented for purposes of elucidation, and not limitation, of the present invention. While specific nucleic acid and amino acid sequences are disclosed herein, those of ordinary skill in the art are credited with the ability to make minor modifications to these sequences while achieving the same or substantially similar results as reported below. The traditional approach to application or understanding of sequence cassettes from one sequence to another (e.g. from rat receptor to human receptor or from human receptor A to human receptor B) is generally predicated upon sequence alignment techniques whereby the sequences are aligned in an effort to determine areas of commonality. The mutational approaches disclosed herein do not rely upon a sequence alignment approach but are instead based upon an algorithmic approach and a positional distance from a conserved proline residue located within the TM6 region of GPCRs. Once this approach is secured, those in the art are credited with the ability to make minor modifications thereto to achieve substantially the same results (i.e., constitutive activation) disclosed herein. Such modified approaches are considered within the purview of this disclosure

Example 1
Preparation of Endogenous Known GPCRS

A. Expression By Standard PCR

PCR was performed using a specific cDNA as template and rTth polymerase (Perkin Elmer) with the buffer system provided by the manufacturer, 0.25 $\mu$M of each primer, and 0.2 mM of each 4 nucleotides.

The resulting PCR fragment was digested with the respective restriction sites and cloned into a pCMV expression vector. Nucleic acid and amino acid sequences were thereafter determined and verified. See Table D below:

TABLE D

| Receptor Identifier | Template | Cycle Conditions Min ('), Sec (") | 5' Primer (SEQ.ID.NO.) and Restriction site | 3' Primer (SEQ.ID.NO.) and Restriction site |
| --- | --- | --- | --- | --- |
| 5HT-1A | Genomic DNA | 94° for 1'<br>60° C. for 1'<br>72° for 1'30" | CGGAAGCTTAGC<br>CATGGATGTGCT<br>CAGCCCTGGTCA<br>(1); HindIII | CCGGAATTCCTG<br>GCGGCAGAAGTT<br>ACACTTAATG (2);<br>EcoRI |
| 5HT-1B | Genomic DNA | 94° for 1'<br>60° C. for 1'<br>72° for 1'30" | TCCAAGCTTGGG<br>GCGAGGAGAGCC<br>ATGGAGGA (3);<br>HindIII | GGCGAATTCACTT<br>GTGCACTTAAAA<br>CGTATCAGTT (4);<br>EcoRI |
| 5HT-1D | Genomic DNA | 94° for 1'<br>60° C. for 1'<br>72° for 1'30" | ATCTACCATGTC<br>CCCACTGAACCA<br>GTCAGC (5) | ATAGAATTCGGA<br>GGCCTTCCGGAA<br>AGGGACAA (6);<br>EcoRI |
| 5HT-1E | Genomic DNA | 94° for 1'<br>60° C. for 1'<br>72° for 2'10" | CCACAGTGTCGA<br>CTGAAACAAGGG<br>AAACATGAAC<br>(7); SalI | CAGTATGCTCTCG<br>GCATCTAATGAG<br>(8) |
| 5HT-1E | Genomic DNA | 94° for 1'<br>60° C. for 1'<br>72° for 2'10" | ATCACCATGGAT<br>TTCTTAAATTCAT<br>CTGATC (9) | TTAGGATCCACAT<br>CGACATCGCACA<br>AGCTTTTG (10);<br>BamHI |
| 5HT-2B | Uterus cDNA | 94° for 1'<br>60° C. for 1'<br>72° for 1'30" | GAAAAGCTTGCC<br>ATGGCTCTCTCTT<br>ACAGAGTGTCTG<br>(11); HindIII | GTTGGATCCTACA<br>TAACTAACTTGCT<br>CTTCAGTTT (12);<br>BamHI |
| 5HT-4A | Brain cDNA | 94° for 1'<br>60° C. for 1'<br>72° for 1'30" | ATCACCATGGAC<br>AAACTTGATGCT<br>AATGTGAG (13) | CCTGAATTCGAA<br>GCATGATTCCAG<br>GGATTCTGG (14);<br>EcoRI |
| 5HT-4B | Brain cDNA | 94° for 1'<br>60° C. for 1'<br>72° for 1'30" | ATCACCATGGAC<br>AAACTTGATGCT<br>AATGTGAG (15) | AGGGAATTCAGT<br>GTCACTGGGCTG<br>AGCAGCCAC (16);<br>EcoRI |

TABLE D-continued

| Receptor Identifier | Template | Cycle Conditions Min ('), Sec (") | 5' Primer (SEQ.ID.NO.) and Restriction site | 3' Primer (SEQ.ID.NO.) and Restriction site |
|---|---|---|---|---|
| 5HT-4C | Brain cDNA | 94° for 1'<br>60° C. for 1'<br>72° for 1'30" | ATCACCATGGAC AAACTTGATGCT AATGTGAG (17) | TTGGAATTCGGAT GGTTTGGTCAATC TTCTCTTC (18); EcoRI |
| 5HT-4D | 5HT-4E DNA | 94° for 1'<br>60° C. for 1'<br>72° for 2" | ATCACCATGGAC AAACTTGATGCT AATGTGAG (19) | AGGGAATTCAAA TCTTAGTACATGT GTGGATCCATTA AT (20); EcoRI |
| 5HT-4E | Brain cDNA | 94° for 1'<br>60° C. for 1'<br>72° for 1'15" | ATCACCATGGAC AAACTTGATGCT AATGTGAG (21) | TCAGAATTCGAC AGGAACTGGTCT ATTGCAGAA (22); EcoRI |
| 5HT-5A | Brain cDNA | 94° for 1'<br>60° C. for 1'<br>72° for 2'10" | CCTAAGCTTGCC ATGGATTTACCA GTGAACCTAACC TCC (23); HindIII | TCTGAATTCGTGT TGCCTAGAAAAG AAGTTCTTGA (24); EcoRI |
| 5HT-6 | See alternative approach below | See alternative approach below | See alternative approach below | See alternative approach below |
| 5HT-7 | Brain cDNA | 94° C. for 1'<br>72° C. for 2" | AGCGGAATTCGG CGGCGCGATGAT GGACGTT (25); EcoRI | TTTCGGATCCATT GTTCTGCTTTCAA TCAT (26); BamHI |
| AVPR1A | See alternative approach below | See alternative approach below | See alternative approach below | See alternative approach below |
| AVPR1A variant | See alternative approach below | See alternative approach below | See alternative approach below | See alternative approach below |
| AVPR1B | See alternative approach below | See alternative approach below | See alternative approach below | See alternative approach below |
| AVPR2 | IMAGE 301449 | pfu PCR<br>94° for 1'<br>63° C. for 1'<br>72° for 2" | CAGGAATTCAGA ACACCTGCCCCA GCCCCAC (27); EcoRI | AGCGGATCCCGA TGAAGTGTCCTTG GCCAGGGA (28); BamHI |
| BBR3 | Uterus cDNA | 94° C. for 1'<br>56° C. for 1'<br>72° C. for 1'20" | ACAGAATTCAGA AGAAATGGCTCA AAGGCA (29); EcoRI | CATGGATCCTTGA AAAGCTAGAAAC TGTCC (30); BamHI |
| BDKR1 | IMAGE 1472696 | pfu PCR<br>94° for 1'<br>65° C. for 1'<br>72° for 2" | TGTAAGCTTCAG GTCACTGTGCAT GGCATCATC (31); HindIII | GCTGGATCCATTC CGCCAGAAAAGT TGGAAGATTTC (32); BamHI |
| BDKR2 | IMAGE 1682455 | pfu PCR<br>94° for 1'<br>65° C. for 1'<br>72° for 2" | ACTAAGCTTCCA AATGTTCTCTCCC TGGAAGATA (33) HindIII | GTTGAATTCCTGT CTGCTCCCTGCCC AGTCCTG (34); EcoRI |
| C3a | Genomic DNA | 94° for 1'<br>65° C. for 1'<br>72° for 1'30" | CAGAAGCTTAGC AATGGCGTCTTT CTCTGCTG (35); HindIII | ACAGGATCCCAC AGTTGTACTATTT CTTTCTGAAATG (36); BamHI |
| C5a | Thymus | 94° for 1'<br>65° C. for 1'<br>72° for 1'10" | GGGAAGCTTAGG AGACCAGAACAT GAACTCCTTC (37); HindIII | TGTGAATTCCACT GCCTGGGTCTTCT GGGCCAT (38); EcoRI |
| CB1 | EST 01536 | pfu PCR<br>94° for 1'<br>65° C. for 1'<br>72° for 2'30" | GGGAAGCTTTCT CAGTCATTTTGA GCTCAGCC (39); HindIII | TCAGAATTCCAG AGCCTCGGCAGA CGTGTCTGT (40); EcoRI |

TABLE D-continued

| Receptor Identifier | Template | Cycle Conditions Min ('), Sec (") | 5' Primer (SEQ.ID.NO.) and Restriction site | 3' Primer (SEQ.ID.NO.) and Restriction site |
|---|---|---|---|---|
| CB2 | IMAGE 1301708 | pfu PCR<br>94° for 1'<br>60° C. for 1'<br>72° for 2" | CAAAAGCTTCTA GACAAGCTCAGT GGAATCTGA (41); HindIII | GCCGAATTCGCA ATCAGAGAGGTC TAGATCTCTG (42); EcoRI |
| CCR2b | Genomic DNA | 94° for 1'<br>60° C. for 1'<br>72° for 1'10" | GACAAGCTTCCC CAGTACATCCAC AACATGC (43); HindIII | CTCGGATCCTAA ACCAGCCGAGAC TTCCTGCTC (44); BamHI |
| CCR3 | Genomic DNA | 94° for 1'<br>60° C. for 1'<br>72° for 1'10" | ATCGCCATGACA ACCTCACTAGAT ACAGTTGAG (45) | TCTGAATTCAAAC ACAATAGAGAGT TCCGGCTC (46); EcoRI |
| CCR5 | Genomic DNA | 94° for 1'<br>62° C. for 1'<br>72° for 1'10" | GCAAAGCTTGGA ACAAGATGGATT ATCAAGTGTC (47); HindIII | TCCGGATCCCAA GCCCACAGATAT TTCCTGCTC (48); BamHI |
| CCR8 | Genomic DNA | 94° for 1'<br>60° C. for 1'<br>72° for 1'10" | TGAAAGCTTCCC GCTGCCTTGATG GATTATAC (49); HindIII | TGAGAATTCCAA AATGTAGTCTAC GCTGGAGGAA (50); EcoRI |
| CCR9 | Genomic DNA | 94° for 1'<br>60° C. for 1'<br>72° for 1'10" | ATCACCATGACA CCCACAGACTTC ACAAGCCCTATT CCTAACATGGCT GATGACTATGG (51) | GACGAATTCGAG GGAGAGTGCTCC TGAGGTTGT (52); EcoRI |
| CRFR1 | Pituitary cDNA | 94° for 1'<br>65° C. for 1'<br>72° for 1'20" | ATCACCATGGGA GGGCACCCGCAG CTCCGT (53) | CGGGAATTCGAC TGCTGTGGACTGC TTGATGCT (54); EcoRI |
| CXCR4 | Genomic DNA | 94° for 1'<br>65° C.<br>72° for 1' | ATCACCATGGAG GGGATCAGTATA TACACTTCAGAT AACTACACCGAG GAAATG (55) | TCTGAATTCGCTG GAGTGAAAACTT GAAGACTCAG (56); EcoRI |
| Dopamine D1 | See alternative approach below | See alternative approach below | See alternative approach below | See alternative approach below |
| Dopamine D2 | See alternative approach below | See alternative approach below | See alternative approach below | See alternative approach below |
| Dopamine D3 | Brain cDNA | 94° C. for 1'<br>62° for 1'20"<br>72° C. for 1'20" | AAGAAGCTTGGC ATCACGCACCTC CTCTGG(57); HindIII | GGCTCTAGAAAT GGGTACAAAGAG TGTT (58); XbaI |
| Dopamine D5 | Genomic DNA | See alternative approach below | See alternative approach below | See alternative approach below |
| ETA | See alternative approach below | See alternative approach below | See alternative approach below | See alternative approach below |
| ETB | IMAGE 1086987 | pfu PCR<br>94° for 1'<br>60° C. for 1'<br>72° for 2'20" | CGGAAGCTTCTG GAGCAGGTAGCA GCATG (59); HindIII | CTTGGATCCAGAT GAGCTGTATTTAT TACTGGAACG (60); BamHI |
| FPR1 | IMAGE 2153284 | 94° C. for 1'<br>63° for 1'<br>72° C. for 2'30" | ATCACCATGGAG ACAAATTCCTCT CTCCCC (61) | CCCGAATTCCTTT GCCTGTAACTCCA CCTCTGC (62); EcoRI |
| FPRL1 | Genomic DNA | 94° C. for 1'<br>65° for 1'<br>72° C. for 1'10" | GCAAAGCTTGCT GCTGGCAAGATG GAAACCAAC (63); HindIII | CCAGAATTCCATT GCCTGTAACTCA GTCTCTGC (64); EcoRI |

TABLE D-continued

| Receptor Identifier | Template | Cycle Conditions Min ('), Sec (") | 5' Primer (SEQ.ID.NO.) and Restriction site | 3' Primer (SEQ.ID.NO.) and Restriction site |
|---|---|---|---|---|
| GALR1 | Stomach cDNA | 94° C. for 1'<br>60° for 1'20"<br>72° C. for 1'20" | CCGGAATTCGCC GGGACAGCCCCG CGGGCC (65); EcoRI | GCAGGATCCTTAT CACACATGAGTA CAATTGGT (66); BamHI |
| GALR2 | Hippocampus cDNA | 94° C. for 1'<br>62° for 1'20"<br>72° C. for 1'20" | GGCGAATTCGGG GTCAGCGGCACC ATGAACG (67); EcoRI | GTGGGATCCCAG CGCGCCCGCTAA GTGCT (68); BamHI |
| GIP | Brain cDNA | 94° for 1'<br>65° C. for 1'<br>72° for 1'30" | CAGAAGCTTCGC CGCCCTCACGAT GACTAC (69); HindIII | CGCGAATTCGCA GTAACTTTCCAAC TCCCGGCT (70); EcoRI |
| mGluR1 | See alternative approach below | See alternative approach below | See alternative approach below | See alternative approach below |
| GPR5 | Genomic DNA | 94° C. for 1'<br>64° for 1'<br>72° C. for 1'30" | TATGAATTCAGA TGCTCTAAACGT CCCTGC (71); EcoRI | TCCGGATCCACCT GCACCTGCGCCT GCACC (72); BamHI |
| GPR24 (also known as MCH or SLC-1) | See alternative approach below | See alternative approach below | See alternative approach below | See alternative approach below |
| GRPR | Stomach cDNA | 94° C. for 1'<br>56° for 1'20"<br>65° C. for 1'20" | AGGAAGCTTTTA GGTGGGAAAAA AAATCTA (73); HindIII | CCGGAATTCAAG GGGCAAAATCAA GGGTCAA (74); EcoRI |
| M1 | Genomic DNA | 94° C. for 1'<br>60° for 1'<br>72° C. for 1'50" | GCCAAGCTTAGC CACCATGAACAC TTCAGCCC (75); HindIII | GGAGAATTCGCA TTGGCGGGAGGG AGTGCGGTG (76); EcoRI |
| M2 | Genomic DNA | 94° C. for 1'<br>60° for 1'<br>72° C. for 1'50" | ATCACCATGAAT AACTCAACAAAC TCCTCTAAC (77) | GATGAATTCCCTT GTAGCGCCTATGT TCTTATA (78); EcoRI |
| M3 | Genomic DNA | 94° C. for 1'<br>60° for 1'<br>72° C. for 1'50" | ATCACCATGACC TTGCACAATAAC AGTACAAC (79) | CTCGAAATTCCA AGGCCTGCTCGG GTGCGCGCT (80); EcoRI |
| M4 | Genomic DNA | 94° C. for 1'<br>60° for 1'<br>72° C. for 1'50" | ATCACCATGGCC AACTTCACACCT GTCAA (81) | GCCGAATTCCCTG GCAGTGCCGATG TTCCGATA (82); EcoRI |
| M5 | Genomic DNA | 94° C. for 1'<br>60° for 1'<br>72° C. for 1'50" | ATCACCATGGAA GGGGATTCTTAC CACAAT (83) | GACGGATCCGGG TAGCTTGCTGTTC CCCTGCCA (84); BamHI |
| MC3 | Genomic DNA | 94° C. for 1'<br>54° for 1'30"<br>72° C. for 1'20" | CAGGAATTCTGA CAGCAATGAATG CTTCGT (85); EcoRI | AATGGATCCTATC CCAAGTTCATGCC GTTGCAG (86); BamHI |
| NK1R | Brain cDNA | 94° C. for 1'<br>65° for 1'<br>72° C. for 1'50" | AGTAAGCTTTAC GCCTAGCTTCGA AATGGAT (87); HindIII | TGTGAATTCGGA GAGCACATTGGA GGAGAAGCT (88); EcoRI |
| NK2R | Uterus cDNA | 94° C. for 1'<br>65° for 1'<br>72° C. for 1'50" | TCCAAGCTTAGA AGCAGCCATGGG GACCTGTGACA (89); HindIII | AACGAATTCAAT TTCAACATGAGTT TTGGTGGGGG (90); EcoRI |

TABLE D-continued

| Receptor Identifier | Template | Cycle Conditions Min ('), Sec (") | 5' Primer (SEQ.ID.NO.) and Restriction site | 3' Primer (SEQ.ID.NO.) and Restriction site |
| --- | --- | --- | --- | --- |
| NK3R | Brain cDNA | 94° C. for 1'<br>65° for 1'20"<br>72° C. for 1'20" | ATCTGCAGACCG GTGGCGATGGCC ACT (91) | ATGGGATCCAGA ATATTCATCCACA GAGGTATAGG (92); BamHI |
| NMBR | Brain cDNA | 94° C. for 1'<br>65° for 1'20"<br>72° C. for 1'20" | TGAGAATTCCAG CGGACTCTGCTG GAAAGGA (93); EcoRI | GTTGGATCCAGG TAGTGAGTTGAA TGGCCA (94); BamHI |
| NPY5 | Genomic DNA | 94° C. for 1'<br>54° for 1'30"<br>72° C. for 1'20" | GGAAAGCTTCAA GAAAGACTATAA TATGGAT (95); HindIII | GGAGGATCCAGT GAGAATTATTAC ATATGAAG (96); BamHI |
| NTSR1 | See alternative approach below | See alternative approach below | See alternative approach below | See alternative approach below |
| NTSR2 | See alternative approach below | See alternative approach below | See alternative approach below | See alternative approach below |
| OPRD | Brain cDNA | 94° C. for 1'<br>65° for 1'<br>72° C. for 1'15 | CGGAAGCTTGCA GCCATGGAACCG GCCCCCTCC (97); HindIII | GCCGAATTCGGC GGCAGCGCCACC GCCGGGACC (98); EcoRI |
| OPRL1 | Brain cDNA | 94° C. for 1'<br>65° for 1'<br>72° C. for 1'15" | AGTAAGCTTGCA GGGCAGTGGCAT GGAGCCC (99); HindIII | GCCGAATTCTGC GGGCCGCGGTAC CGTCTCAGA (100); EcoRI |
| OPRK | Brain cDNA | 94° C. for 1'<br>65° for 1'<br>72° C. for 1'15" | TTTAAGCTTGCA GCACTCACCATG GAATCCCCGAT (101); HindIII | CTACTGGTTTATT CATCCCATCGATG TC (102); |
| OPRM | See alternative approach below | See alternative approach below | See alternative approach below | See alternative approach below |
| OPRM1A | See alternative approach below | See alternative approach below | See alternative approach below | See alternative approach below |
| $OX_1R$ | See alternative approach below | See alternative approach below | See alternative approach below | See alternative approach below |
| $OX_2R$ | Brain cDNA | 94° C. for 1'<br>65° for 1'<br>72° C. for 1'20" | ACCAAGCTTGAG CCCGTGATGTCC GGCACC (103); HindIII | CAGGGATCCTTGT CATATGAATAAA TATT (104); BamHI |
| PACAP | Fetal Brain cDNA | 94° C. for 1'<br>65° for 1'<br>72° C. for 1'30" | AGTAAGCTTGGC CAAGAAGTGTCA TGGCTGGTG (105); HindIII | CATGAATTCGGT GGCCAGATTGTC AGCAGGGAG (106); EcoRI |
| PAF | Genomic DNA | 94° C. for 1'<br>63° for 1'<br>72° C. for 2'30" | CTGAAGCTTCCA GCCCACAGCAAT GGAGCCA (107); HindIII | CAGGAATTCATTT TTGAGGGAATTG CCAGGGATCTG (108); EcoRI |
| PGE EP1 | cDNA clone | pfu PCR<br>94° C. for 1'<br>63° for 1'<br>72° C. for 2'30" | ATCGCCATGAGC CCTTGCGGGCCC CTCAA (109) | TTGGAATTCGAA GTGGCTGAGGCC GCTGTGCCG (110); EcoRI |
| PGE EP2 | Thymus cDNA | 94° C. for 1'<br>63° for 1'<br>72° C. for 2'30" | GCAAAGCTTTTC CAGGCACCCCAC CATGGGC (111); HindIII | CTGGAATTCAAG GTCAGCCTGTTTA CTGGCATC (112); EcoRI |
| PGE EP4 | cDNA clone | pfu PCR<br>94° C. for 1'<br>60° for 1'<br>72° C. for 2'30" | ATCATCATGTCC ACTCCCGGGGTC AAT (113) | TGCGAATTCTATA CATTTTTCTGATA AGTTCAGTGTT (114); EcoRI |

TABLE D-continued

| Receptor Identifier | Template | Cycle Conditions Min ('), Sec (") | 5' Primer (SEQ.ID.NO.) and Restriction site | 3' Primer (SEQ.ID.NO.) and Restriction site |
|---|---|---|---|---|
| PTHR1 | See alternative approach below | See alternative approach below | See alternative approach below | See alternative approach below |
| PTHR2 | Brain cDNA | 94° C. for 1'<br>65° for 1'<br>72° C. for 1'50" | CTGAAGCTTCCT ACAGCCGTTCCG GGCATG (115); HindIII | CGAGAACATCCT CAGTTTCTCCTTG G (116) |
| SCTR | Small Intestine | 94° C. for 1'<br>65° for 1'<br>72° C. for 1'45" | GGGAAGCTTGCG GGCACCATGCGT CCCCACCT (117); HindIII | AGCGAATTCGAT GATGCTGGTCCTG CAGGTGCC (118); EcoRI |
| SST1 | Genomic DNA | 94° C. for 1'<br>65° for 1'20"<br>72° C. for 1'20" | GCCGAATTCAGC TGGGATGTTCCC CAATGGC (119); EcoRI | CAGGGATCCTGC GTGGCCCGGGCT CAGAGCG (120); BamHI |
| SST2 | See alternative approach below | See alternative approach below | See alternative approach below | See alternative approach below |
| SST3 | Genomic DNA | 94° C. for 1'<br>65° for 1'20"<br>72° C. for 1'20" | ACGGAATTCCCC TCAGCCATGGAC ATGCTTC (121); EcoRI | TGGGATCCCCAG GCCCCTACAGGT AGCTG (122); BamHI |
| SST4 | Genomic DNA | 94° C. for 1'<br>65° for 1'20"<br>72° C. for 1'20" | GCCGAATTCAGC TGCCCTGCGCCG GCACCCC (123); EcoRI | GAGGGATCCACG CAGGGTGGGTAG GGGAAGG (124); BamHI |
| SST5 | Genomic DNA | 94° C. for 1'<br>65° for 1'20"<br>72° C. for 1'20" | TCTAAGCTTGCA GAGCCTGACGCA CCCCAG (125); HindIII | CCTGAATTCCTGG GGGTGACACGGG GCCGCC (126); EcoRI |
| TSHR | Genomic DNA | 94° C. for 1'<br>65° for 1'<br>72° C. for 2'30" | GGCGAATTCGGA GGATGGAGAAAT AGCCCC (127); EcoRI | GTAGGATCCCCT ACCATTGTGAGT AGTGTA (128); BamHI |
| VIPR1 | Lung cDNA | 94° C. for 1'<br>65° for 1'<br>72° C. for 1'30" | CCGAAGCTTCAG GGCAGACCATGC GCCCGCCA (129); HindIII | TGGGAATTCGAC CAGGGAGACTTC GGCTTGGAA (130); EcoRI |
| VIPR2 | Brain cDNA | 94° C. for 1'<br>65° for 1'<br>72° C. for 1'30" | GCTAAGCTTGCC ATGCGGACGCTG CTGCCTCCCGCG (131); HindIII | GTGGAATTCGAT GACCGAGGTCTC CGTTTGCAG (132); EcoRI |

B. Expression by Alternative Approaches

1. AVPR1A

The endogenous human AVPR1A was obtained by PCR using a template and rTth polymerase (Perkin Elmer) with the buffer system provided by the manufacturer, 0.25 μM of each primer, and 0.2 mM of each 4 nucleotides. The cycle condition was 30 cycles of 94° C. for 1 min, 64° C. for 1 min and 72° C. for 1 min and 30 sec. The 5' PCR fragment was obtained utilizing genomic DNA, as a template, and the following primer set:

(SEQ.ID.NO.:133)
5'-ATCACCATGCGTCTCTCCGCCGGTCCCGA-3' and (SEQ.ID.NO.:134)
5'-TTGTTCACCTCGATCATGGAGAAGA-3'.

The 3' PCR fragment was obtained by pfu polymerase (Stratagene) using IMAGE 1055179, as a template, and the following primer set:

(SEQ.ID.NO.:135)
5'-CGCAGTACTTCGTCTTCTCCATGA-3' and (SEQ.ID.NO.:136)
5'-CAAGAATTCAGTTGAAACAGGAATGAATTTGATGG-3'.

The cycle condition for 3' PCR reaction was as follows: 30 cycles of 94° C. for 1 min, 60° C. and 72° C. for 1 min 30 sec. The 5' and 3' PCR fragments were then used as co-templates to obtain the full length cDNA using the pfu polymerase and SEQ. ID. NO.:133 and SEQ. ID. NO.:136 as primers. The cycle condition for each PCR reaction was 30 cycles of 94° C. for 1 min, 65° C. and 72° C. for 2 min 10 sec.

The resulting PCR fragment was digested with EcoRI restriction site and cloned into an EcoRI pCMV expression vector. Nucleic acid and amino acid sequences were thereafter determined and verified.

2. AVPR1A Variant

The endogenous human AVPR1A variant was obtained by PCR using a template and rTth polymerase (Perkin Elmer) with the buffer system provided by the manufacturer, 0.25 µM of each primer, and 0.2 mM of each 4 nucleotides. The cycle condition was 30 cycles of 94° C. for 1 min, 64° C. for 1 min and 72° C. for 1 min and 30 sec. The 5' PCR fragment was obtained utilizing genomic DNA, as a template, and: SEQ. ID. NO.:133 and SEQ. ID. NO.:134 as primers.

The 3' PCR fragment was obtained by pfu polymerase (Stratagene) using IMAGE 1542469, as a template, and SEQ. ID. NO.:136 and 5'-ACAGAATTCTCCAGTTCTCATTTTCTTATCCG TAC-3' (SEQ. ID. NO.:137).

The cycle condition for 3' PCR reaction was as follows: 30 cycles of 94° C. for 1 min, 65° C. for 1 min and 72° C. for 1 min 30 sec. The 5' and 3' PCR fragments were then used as co-templates to obtain the full length cDNA using the pfu polymerase (Stratagene) and SEQ. ID. NO.:133 and SEQ. ID. NO.:136 as primers. The cycle condition for each PCR reaction was 30 cycles of 94° C. for 1 min, 65° C. for 1 min and 72° C. for 2 min 10 sec.

The resulting PCR fragment was digested with EcoRI restriction site and cloned into an EcoRI pCMV expression vector. Nucleic acid and amino acid sequences were thereafter determined and verified.

3. AVPR1B

The endogenous human AVPR1B was obtained by PCR using a template and rTth polymerase (Perkin Elmer) with the buffer system provided by the manufacturer, 0.25 µM of each primer, and 0.2 mM of each 4 nucleotides. Both rounds of PCR had the following cycle condition: 30 cycles of 94° C. for 1 min, 65° C. for 1 min and 72° C. for 2 sec. The first round of PCR utilized a pituitary DNA, as a template, and a 5' PCR primer that contained a HindIII site with the following sequence: 5'-GCAAAGCTTGCTCATGGATTCTGGGCCTCT-3' (SEQ. ID. NO.:138) The 3' PCR primer contained an EcoRI site with the following sequence: 5'-TCTGAATTCAAAGATGATGGTCTCAGCGGTGCC-3'-(SEQ. ID. NO.:139). The second round of PCR utilized pituitary DNA as a template and a 5' PCR primer contained a HindIII site with the following sequence: 5'-GCAAAGCTTGCTCATGGATTCTGGGCCTCTGT GGG-3' (SEQ. ID. NO.:140) and the 3' PCR primer contained an EcoRI site with the following sequence: 5'-TCTGAATTCAAAGATGATGGTCTCAGCGGTGC CTTCCC-3' (SEQ. ID. NO.:141).

The resulting PCR fragment was digested with HindIII and EcoRI restriction site and cloned into a HindIII-EcoRI pCMN expression vector. Nucleic acid and amino acid sequences were thereafter determined and verified.

4. 5HT6

The endogenous human 5HT6 receptor was obtained by PCR using a template and rTth polymerase (Perkin Elmer) with the buffer system provided by the manufacturer, 0.25 µM of each primer, and 0.2 mM of each 4 nucleotides. Both rounds of PCR had the following cycle condition: 30 cycles of 94° C. for 1 min, 60° C. for 1 min and 72° C. for 1 min and 45 sec. The first round of PCR utilized a caudate nucleus DNA, as a template, and a 5' PCR primer that contained a HindIII site with the following sequence: 5'-CATAAGCTTTCCCGCCACCCTATCACT-3' (SEQ. ID. NO.:142) The 3' PCR primer contained an EcoRI site with the following sequence: 5'-ACTGAATTCTGCTCAATCCAGCTCCCCA-3'-(SEQ. ID. NO.:143). The second round of PCR also utilized caudate nucleus DNA as a template and a 5' PCR primer that contained an EcoRV site with the following sequence: 5'-CCTCGGATATCATGGTCCCAGAGCCGGGCCC-3' (SEQ. ID. NO.:144) and a 3' PCR primer that contained a XbaI site with the following sequence: 5'-CAGCTCTAGATTGGCCAGCCCCAAGCCCGGGT-3' (SEQ. ID. NO.:145).

Nucleic acid and amino acid sequences were thereafter determined and verified.

5. Dopamine D1

Dopamine D1 was subcloned from a full length cDNA clone obtained from the American Type Culture Collection.

6. Dopamine D2

Dopamine D2 was subcloned from a full length cDNA clone obtained from the American Type Culture Collection.

7. Dopamine D5

To obtain Dopamine D5, PCR was performed using genomic cDNA as template and rTth polymerase (Perkin Elmer) with the buffer system provided by the manufacturer, 0.25 µM of each primer, and 0.2 mM of each 4 nucleotides.

Dopamine D5 receptor contained no intron in the coding region. However, Dopamine D5 receptor contained two pseudogenes with 8 bp fame shift insertion within the coding region. In order to avoid the pseudogenes, the DNA fragment 5' and 3' of the frame shift insert was each amplified from genomic DNA. The 5' PCR fragment was obtained utilizing the following primer set:

```
                                    (SEQ.ID.NO.:146; sense)
5'-CCTGAATTCCAGCCCGAAATGCTGCCGCCAG-3'

(SEQ.ID.NO.:147; antisense)
5'-GGTCCACGCTGATGACGCACAGGTTC-3'
```

3' fragment was obtained utilizing the following primer set:

```
                                    (SEQ.ID.NO.: 148; sense)
5'-GAACCTGTGCGTCATCAGCGTGGACC-3'

(SEQ.ID.NO.:149; antisense)
5'-TGCGGATCCATGAGGGGGTTTCTTAATG-3'.
```

The 5' and 3' PCR fragments were then used as co-templates to obtain the full length cDNA using the pfu polymerase and SEQ. ID. NO.:146 and SEQ. ID. NO.:149 as primers. The cycle condition for each PCR reaction was 30 cycles of 94° C. for 1 min, 65° C. for 2 min 30 sec and 72° C. for 1 min 30 sec.

The resulting PCR fragment was digested with EcoRI and Bamboo restriction sites and cloned into an EcoRI-BamHI pCMV expression vector. Nucleic acid and amino acid sequences were thereafter determined and verified.

8. ETA

The endogenous human ETA was obtained by PCR using a template and rTth polymerase (Perkin Elmer) with the buffer system provided by the manufacturer, 0.25 µM of each primer, and 0.2 mM of each 4 nucleotides. The cycle condition was 30 cycles of 94° C. for 1 min, 65° C. for 1 min and 72° C. for 2 sec. The 5' PCR fragment, containing a HindIII site, was obtained utilizing genomic DNA, as a template, and the following primer set:

```
                                    (SEQ.ID.NO.:150)
5'-CGGAAGCTTCTGGAGCAGGTAGCAGCATG-3' and (SEQ.ID.NO.:151)
5'-TGGGCAATAGTTGTGCATTGAGCCA-3'.
```

The 3' PCR fragment, containing BamHI site, was obtained by pfu polymerase (Stratagene) using IMAGE 666747, as a template, and the following primer set:

```
                                           (SEQ.ID.NO.:152)
5'-CTAATTTGGTCCTACCCAGCAATGGC-3' and (SEQ.ID.NO.:153)
5'-CTTGGATCCAGATGAGCTGTATTTATTACTGGAACG-3'.
```

The cycle condition for 3' PCR reaction was as follows: 30 cycles of 94° C. for 1 min, 64° C. for 1 min and 72° C. for 2 sec. The 5' and 3' PCR fragments were then used as co-templates to obtain the full length cDNA using the pfu polymerase (Stratagene) and the following primers:

```
                                           (SEQ ID.NO.:154)
5'-AATAAGCTTCAAGATGGAAACCCTTTGCCCTCAG-3'

(SEQ.ID.NO.:155)
5'-CGTTCATGCTGTCCTTATGGCTGCTC-3'.
```

The PCR cycle condition for the full length clone was 30 cycles of 94° C. for 1 min, 65° C. for 1 min and 72° C. for 2 min 10 sec.

The resulting PCR fragment was digested with EcoRI restriction site and cloned into an EcoRI pCMV expression vector. Nucleic acid and amino acid sequences were thereafter determined and verified.

9. mGluR1

The endogenous human mGluR1 was obtained by PCR using a template and rTth polymerase (Perkin Elmer) with the buffer system provided by the manufacturer. The cycle condition for the first round of PCR was as follows: 30 cycles of 94° C. for 1 min, 65° C. for 1 min and 72° C. for 1 min and 50 sec. The 5' PCR fragment contained a SalI site and was obtained utilizing hippocampus DNA as a template, and the following primer set:

```
                                           (SEQ.ID.NO.:156)
5'-GCAGGCTGTCGACCTCGTCCTCACCACCATGGTC-3' and (SEQ.ID.NO.:157)
5'-AATGGGCTCACAGCCTGTTAGATCTGCATTGGGCCAC-3'.
```

The middle PCR fragment was obtained utilizing genomic DNA as a template, where the cycle condition was 30 cycles of 94° C. for 1 min, 65° C. for 1 min and 72° C. for 1 min and 50 sec, with the following primer set:

```
                                           (SEQ.ID.NO.:158)
5'-TAACAGGCTGTGAGCCCATTCCTGTGCG-3' and (SEQ.ID.NO.:159)
5'-TTAGAATTCGCATTCCCTGCCCCTGCCTTCTTTC-3'.
```

The 3' PCR fragment contained a BamHI site and was obtained utilizing genomic cDNA, as a template, and the following primer set:

```
                                           (SEQ.ID.NO.:160)
5'-TGCGAATTCTAATGGCAAGTCTGTGTCATGGTC-3' and (SEQ.ID.NO.:161)
5'-TCCGGATCCCAGGGTGGAAGAGCTTTGCTTGTA-3'.
```

The cycle condition for 3' PCR reaction was as follows: 30 cycles of 94° C. for 1 min, 65° C. for 1 min and 72° C. for 1 min and 15 sec.

The resulting PCR fragment was digested with SalI and BamHI restriction site and cloned into a SalI-BamHI pCMV expression vector. Nucleic acid and amino acid sequences were thereafter determined and verified.

10. GPR24 (Also Known as MCH or SLC-1)

The endogenous human GPR24 was obtained by PCR using genomic DNA as template and rTth polymerase (Perkin Elmer) with the buffer system provided by the manufacturer, 0.25 µM of each primer, and 0.2 mM of each 4 nucleotides. The cycle condition was 30 cycles of 94° C. for 1 min, 56° C. for 1 min and 72° C. for 1 min and 20 sec.

The 5' PCR primer contained a HindIII site with the sequence: 5'-GTGAAGCTTGCCTCTGGTGCCTGCAGGAGG-3' (SEQ. ID. NO.:162) and the 3' primer contained an EcoRI site with the sequence: 5'-GCAGAATTCCCGGTGGCGTGTTGTGGTGCCC-3' (SEQ. ID. NO.:163).

The 1.3 kb PCR fragment was digested with HindIII and EcoRI and cloned into HindIII-EcoRI site of CMVp expression vector. Later the cloning work by Lakaye et al showed that there is an intron in the coding region of the gene. Thus the 5' end of the cDNA was obtained by 5' RACE PCR using Clontech's marathon-ready hypothalamus cDNA as template and the manufacturer's recommended protocol for cycling condition. The 5' RACE PCR for the first and second round PCR were as follows:

```
5'-CATGAGCTGGTGGATCATGAAGGG-3'      (SEQ.ID.NO.:164)
and

5'-ATGAAGGGCATGCCCAGGAGAAAG-3'.     (SEQ.ID.NO.:165)
```

Nucleic acid and amino acid sequences were thereafter determined and verified.

11. NTSR1

The endogenous human NTSR1 was obtained by PCR using a template and rTth polymerase (Perkin Elmer) with the buffer system provided by the manufacturer, 0.25 µM of each primer, and 0.2 mM of each 4 nucleotides. The cycle condition was 30 cycles of 94° C. for 1 min, 60° C. for 1 min and 72° C. for 1 min and 10 sec. The 5' PCR fragment, containing a HindIII site, was obtained utilizing genomic DNA, as a template, and the following primer set:

```
                                           (SEQ.ID.NO.:166)
5'-CCCAAGCTTCCAGCCCCGGAGGCGCCGGAC-3' and (SEQ.ID.NO.:167)
5'-TGAAGGTGTTGACCTGTATGACGACCTTGACGGTGGG-3'.
```

The 3' PCR fragment, containing an EcoRI site, was obtained utilizing brain cDNA, as a template, and the following primer set:

```
                                           (SEQ.ID.NO.:168)
5'-GGTCGTCATACAGGTCAACACCTTCATGTCCTTCATA-3' and (SEQ.ID.NO.:169)
5'-CACGAATTCGTACAGCGTCTCGCGGGTGGCATT-3'.
```

The cycle condition for 3' PCR reaction was as follows: 30 cycles of 94° C. for 1 min, 60° C. for 1 min and 72° C. for 1 min and 10 sec. The 5' and 3' PCR fragments were then used as co-templates to obtain the full length cDNA using the pfu polymerase (Stratagene) and 5'-ATCACCATGCGCCTCAACAGCTCCGC-3' (SEQ. ID. NO.:170) and SEQ. ID. NO.:169 as primers. The cycle condition for each PCR reaction was 30 cycles of 94° C. for 1 min, 65° C. for 1 min and 72° C. for 2 min 10 sec.

The resulting PCR fragment was digested with HindIII and EcoRI restriction site and cloned into a HindIII-EcoRI pCMV expression vector. Nucleic acid and amino acid sequences were thereafter determined and verified.

12. NTSR2

The endogenous human NTSR2 was obtained by PCR using a template and pfu polymerase (Stratagene) with the buffer system provided by the manufacturer. The cycle condition was 30 cycles of 94° C. for 1 min, 65° C. for 1 min and 72° C. for 1 min and 15 sec. The 5' PCR fragment was obtained utilizing IMAGE 1537523, as a template, and the following primer set:

```
                                         (SEQ.ID.NO.:171)
5'-ATCACCATGGAAACCAGCAGCCCGCGGC-3' and (SEQ.ID.NO.:172)
5'-CGGGGTAGAAGTGGACGGCACTTGGG-3'.
```

The 3' PCR fragment, containing an EcoRI site, was obtained utilizing caudate nucleus cDNA, as a template, and the following primer set:

```
                                         (SEQ.ID.NO.:173)
5'-GCTCCCAAGTGCCGTCCACTTCTACC-3' and (SEQ.ID.NO.:174)
5'-TTAGAATTCGGTCCGGGTTTCTGGGGATCC-3'.
```

The cycle condition for 3' PCR reaction was as follows: 30 cycles of 94° C. for 1 min, 60° C. for 1 min and 72° C. for 1 min and 20 sec. The 5' and 3' PCR fragments were then used as co-templates to obtain the full length cDNA using the pfu polymerase (Stratagene) and SEQ. ID. NO.:171 and SEQ. ID. NO.:174 as primers. The PCR cycle condition for the full length clone was 30 cycles of 94° C. for 1 min, 60° C. for 1 min and 72° C. for 2 min 10 sec.

The resulting PCR fragment was digested with EcoRI restriction site and cloned into an EcoRI pCMV expression vector. Nucleic acid and amino acid sequences were thereafter determined and verified.

13. OPRM1

The endogenous human OPRM1 was obtained by PCR using a template and rTth polymerase (Perkin Elmer) with the buffer system provided by the manufacturer. The cycle condition was 30 cycles of 94° C. for 1 min, 65° C. for 1 min and 72° C. for 40 sec. The 5' PCR fragment, containing a HindIII site, was obtained utilizing genomic DNA as a template, and the following primer set:

```
                                         (SEQ.ID.NO.:175)
5'-CCCAAGCTTCAGTACCATGGACAGCAGCGCTGCC-3' and (SEQ.ID.NO.:176)
5'-CATCTTGGTGTATCTGACAATCACATACATGACCAGGAA-3'.
```

The middle PCR fragment was obtained utilizing genomic DNA as a template, where the cycle condition was 30 cycles of 94° C. for 1 min, 60° C. for 1 min and 72° C. for 40 sec, and the following primer set:

```
                                         (SEQ.ID.NO.:177)
5'-GTATGTGATTGTCAGATACACCAAGATGAAGACTGCCAC-3'
and (SEQ.ID.NO.:178)
5'-TACAATCTATGGAACCTTGCCTGTATTTTGTTGTAGCCA-3'.
```

The 3' PCR fragment was obtained utilizing brain cDNA, as a template, and the following primer set:

```
                                         (SEQ.ID.NO.:179)
5'-CAAAATACAGGCAAGGTTCCATAGATTGTACACTAACAT-3' and (SEQ.ID.NO.:180)
5'-CGGGCAACGGAGCAGTTTCTGCTTCAG-3'.
```

The cycle condition for 3' PCR reaction was as follows: 30 cycles of 94° C. for 1 min, 63° C. for 1 min and 72° C. for 1 min and 15 sec.

The 5'PCR fragment and the middle PCR fragment were used as templates to obtain the 5'-region through the middle region of OPRM1 ("5'-middle PCR fragment") using the pfu polymerase (Stratagene) and SEQ. ID. NO.:175 and SEQ. ID. NO.:178 with the cycle conditions as follows: 30 cycles of 94° C. for 1 min, 63° C. for 1 min and 72° C. for 1 min and 15 sec.

The 5'-middle PCR fragment and 3' PCR fragment were then used as templates to obtain the full length cDNA using the pfu polymerase (Stratagene) and SEQ. ID. NO.:175 and SEQ. ID. NO.:180 as primers. The cycle condition for the full length PCR reaction was 30 cycles of 94° C. for 1 min, 65° C. for 1 min and 72° C. for 1 min 15 sec.

The resulting PCR fragment was digested with Hindi restriction site and cloned into a HindIII pCMV expression vector. Nucleic acid and amino acid sequences were thereafter determined and verified.

14. OPRM1A

The endogenous human OPRM1A was obtained by PCR using a template and rTth polymerase (Perkin Elmer) with the buffer system provided by the manufacturer. The cycle condition was 30 cycles of 94° C. for 1 min, 65° C. for 1 min and 72° C. for 40 sec. The 5' PCR fragment, containing a HindIII site, was obtained utilizing genomic DNA as a template, and SEQ. ID. NO.:175 and SEQ. ID. NO.:176.

The middle PCR fragment was obtained utilizing genomic DNA as a template, where the cycle condition was 30 cycles of 94° C. for 1 min, 60° C. for 1 min and 72° C. for 40 sec, and SEQ. ID. NO.:177 and SEQ. ID. NO.:178.

The 3' PCR fragment was obtained utilizing genomic DNA as a template, and SEQ. ID. NO.:179 and SEQ. ID. NO.:180. The cycle condition for 3' PCR reaction was as follows: 30 cycles of 94° C. for 1 min, 60° C. for 1 min and 72° C. for 1 min and 30 sec.

The 5'PCR fragment and the middle PCR fragment were used as co-templates to obtain the 5'-region through the middle region of OPRM1A ("5'-middle PCR fragment") using the pfu polymerase (Stratagene) and SEQ. ID. NO.:175 and SEQ. ID. NO.:178 with the cycle conditions as follows: 30 cycles of 94° C. for 1 min, 63° C. for 1 min and 72° C. for 1 min and 15 sec.

The 5'-middle PCR fragment and 3' PCR fragment were then used as co-templates to obtain the full length cDNA using the pfu polymerase (Stratagene) and SEQ. ID. NO.:175 and SEQ. ID. NO.:180 as primers. The cycle condition for the full length PCR reaction was 30 cycles of 94° C. for 1 min, 65° C. for 1 min and 72° C. for 1 min 15 sec.

The resulting PCR fragment was digested with HindIII restriction site and cloned into a HindIII pCMV expression vector. Nucleic acid and amino acid sequences were thereafter determined and verified.

15. OX$_1$R

The OX$_1$R EST clone 40608 is a full length cDNA clone. However, it contained a 4 bp frame shift insertion. To remove the insert, the fragments 5, and 3, of the frame shift insert was each obtained by PCR using EST clone 40608 as template and two primer pairs. The 5' primer set, containing an EcoRI site, were as follows:

```
                              (SEQ.ID.No.:181; sense)
5'-ATGGAATTCTGCTGCAGCGGCTCCTGAGCTC-3'

(SEQ.ID.No.:182; antisense)
5'-ACGGACACAGCCTGTAGATAGGGGATGACCTTGCAG-3'
``` and the 3' primer set, containing a BamHI site, were as follows:

```
                              (SEQ.ID.NO.:183; sense)
5'-ATCCCCTATCTACAGGCTGTGTCCGTGTCAGTGGCAG-3'

(SEQ.ID.NO.:184; antisense)
5'-GGAGGATCCAGGGCAGCCCTCGCTCAGGGC-3'.
```

The 5' and 3, PCR fragments were then used as cotemplates to obtain the full length cDNA using SEQ. ID. NO.:181 and SEQ. ID. NO.:184 as primers. The cycle condition for each PCR reaction was 30 cycles of 94° C. for 1 min, 65° C. for 2 min 30 sec and 72° C. for 1 min 30 sec.

The resulting PCR fragment was digested with EcoRI and BamHI restriction sites and cloned into an EcoRI-BamHI pCMV expression vector. Nucleic acid and amino acid sequences were thereafter determined and verified.

16. PTHR1

The endogenous human PTHR1 was obtained by PCR using a template and rTth polymerase (Perkin Elmer) with the buffer system provided by the manufacturer. The cycle condition was 30 cycles of 94° C. for 1 min, 65° C. for 1 min and 72° C. for 1 min and 30 sec. The 5' PCR fragment, containing a HindIII site, was obtained utilizing kidney cDNA, as a template, and the following primer set:

```
                              (SEQ.ID.NO.:185)
5'-CGCAAGCTTAGGCGGTGGCGATGGGGACCGCC-3' and (SEQ.ID.NO.:186)
5'-GGATGTGGTCCCATTCCGGCAGACAG-3'.
```

The 3' PCR fragment, containing an EcoRI site, was obtained by pfu PCR (Stratagene) and IMAGE 1624048, as a template, and the following primer set:

```
                              (SEQ.ID.NO.:187)
5'-AGGAGGCACCCACTGGCAGCAGGTA-3' and (SEQ.ID.NO.:188)
5'-GCCGAATTCCATGACTGTCTCCCACTCTTCCTG-3'.
```

The cycle condition for 3' PCR reaction was as follows: 30 cycles of 94° C. for 1 min, 65° C. for 1 min and 72° C. for 1 min and 30 sec. The 5' and 3' PCR fragments were then used as co-templates to obtain the full length cDNA using the pfu polymerase (Stratagene) and SEQ. ID. NO.:185 and SEQ. ID. NO.:188 as primers. The PCR cycle condition for the full length clone was 30 cycles of 94° C. for 1 min, 65° C. for 1 min and 72° C. for 3 sec.

The resulting PCR fragment was digested with HindIII and EcoRI restriction site and cloned into a HindIII-EcoRI pCMV expression vector. Nucleic acid and amino acid sequences were thereafter determined and verified.

17. SST2

SST2 was obtained by subcloning EST 06818 into a pCMN vector.

Table E below indicates the GenBank Accession number for which the endogenous receptors set forth above can be located, and for which the endogenous nucleic and amino acid sequences are provided.

TABLE E

| Receptor Identifier | GenBank Accession Number |
| --- | --- |
| 5HT-1A | X13556 |
| 5HT-1B | D10995 |
| 5HT-1D | M81589 |
| 5HT-1E | M91467 |
| 5HT-1F | L04962 |
| 5HT-2B | X77307 |
| 5HT-4A | Y08756 |
| 5HT-4B | Y12505 |
| 5HT-4C | Y12506 |
| 5HT-4D | Y12507 |
| 5HT-4E | AJ011371 |
| 5HT-5A | X81411 |
| 5HT6 | L41147 |
| 5HT7 | L21195 |
| AVPR1A | AF030625 |
| AVPR1B | D31833 |
| AVPR2 | NM_000054 |
| BBR3 | X76498 |
| BDKR1 | AJ238044 |
| BDKR2 | NM_000623 |
| C3a | U62027 |
| C5a | M62505 |
| CB1 | X54937 |
| CB2 | X74328 |
| CCR2b | U03882 |
| CCR3 | U28694 |
| CCR5 | U54994 |
| CCR8 | U45983 |
| CCR9 | AJ132337 |
| CRFR1 | L23332 |
| CXCR4 | AJ224869 |
| Dopamine D1 | X55758 |
| Dopamine D2 | S62137 |
| Dopamine D3 | U32499 |
| Dopamine D5 | M67439 |
| ETA | X61950 |
| ETB | L06623 |
| FPR1 | M60627 |
| FPRL1 | M76672 |
| GALR1 | L34339 |
| GALR2 | AF040630 |
| GALR3 | AF073799 |
| GIP | U39231 |
| mGluR1 | L76627 |
| GPR5 | L36149 |
| GPR24 (also known as MCH or SLC-1) | U71092 |
| GRPR | M73481 |
| M1 | X15263 |
| M2 | X15264 |
| M3 | X15266 |
| M4 | X15265 |
| M5 | M80333 |
| MC3 | L06155 |
| NK1R | M74290 |
| NK2R | M57414 |
| NK3R | M89473 |
| NMBR | M73482 |
| NPY5 | U94320 |
| NTSR1 | X70070 |
| NTSR2 | Y10148 |
| OPRD | U07882 |
| OPRL1 | X77130 |
| OPRK | U11053 |
| OPRM | L25119 |
| OPRM1A | L25119 |
| OX$_1$R | AF041243 |
| OX$_2$R | AF041245 |
| PACAP | D17516 |
| PAF | S56396 |
| PGE EP1 | L22647 |
| PGE EP2 | U19487 |
| PGE EP4 | NM_000958 |
| PTHR1 | L04308 |
| PTHR2 | U25128 |

TABLE E-continued

| Receptor Identifier | GenBank Accession Number |
|---|---|
| SCTR | U28281 |
| SST1 | M81829 |
| SST2 | M81830 |
| SST3 | M96738 |
| SST4 | D16826 |
| SST5 | D16827 |
| TSHR | AF035261 |
| VIPR | L13288 |
| VIPR2 | X95097 |

Example 2

Preparation of Non-Endogenous, Versions of the Known GPCRS

A. Site-Directed Mutagenesis

Those skilled in the art are credited with the ability to select techniques for mutation of a nucleic acid sequence. Presented below are approaches utilized to create non-endogenous versions of several of the human GPCRs disclosed above. The mutations disclosed below are based upon an algorithmic approach whereby the $16^{th}$ amino acid (located in the IC3 region of the GPCR) from a conserved proline residue (located in the TM6 region of the GPCR, near the TM6/IC3 interface) is mutated, most preferably to a lysine amino acid residue.

In most of the examples of this Example 2, the algorithmic approach set forth above was used to identify the amino acid residue to be mutated. However, several GPCRs set forth below utilized a modified algorithmic approach (e.g., CRFR1, GIP, mGluR1, GPR24, PTHR1, PTHR2, SCTR, TSHR, VIPR and VIPR2). This modified approach focuses on a conserved proline residue (also located in the TM6 region of the GPCR, near the TM6/IC3 interface) whereby the $5^{th}$ amino acid upstream from the proline is generally, but not always, a threonine residue. For these receptors, the endogenous $5^{th}$ amino acid residue is mutated, most preferably to a proline amino acid residue.

Other mutation approaches can be used (e.g., mGluR1, GPR24 and TSHR) and one skilled in the art is credited with the ability to select techniques for mutation of a nucleic acid sequence. The importance here is that the mutation leads to a constitutively activated receptor and given the extension approaches set forth herein for determination of constitutively activity, routine analysis can be employed in this context.

Preparation of non-endogenous known GPCRs is preferably accomplished by using TRANSFORMER SITE-DIRECTED™ Mutagenesis Kit (Stratagene, according to manufacturer's instructions) or QUIKCHANGE SITE-DIRECTED™ Mutagenesis (Clontech). Endogenous GPCR is preferably used as a template and two mutagenesis primers utilized, as well as, most preferably, a lysine mutagenesis oligonucleotide and a selection marker oligonucleotide (SEQ. ID. NO.:252; included in Stratagene's kit). For convenience, the codon mutation incorporated into the known GPCR and the respective oligonucleotides are noted, in standard form (Table F):

TABLE F

| Receptor Identifier | Codon Mutation | 5'-3' orientation (sense), (SEQ.ID.NO.) mutation underlined | 5'-3' orientation (antisense) (SEQ.ID.NO.) |
|---|---|---|---|
| 5HT-1A | V343K | CGAGAGAGGAAGACA<u>AAG</u> AAGACGCTGGGCAT (189) | ATGCCCAGCGTCTT<u>CTTT</u> GTCTTCCTCTCTCG (190) |
| 5HT-1B | T313K | GGGAGCGCAAAGCC<u>AAGA</u> AGACCCTAGGGATC (191) | GATCCCTAGGGTCTT<u>CTT</u> GGCTTTGCGCTCCC (192) |
| 5HT-1D | T300K | CGAGAAAGGAAAGCC<u>AAG</u> AAAATCCTGGGCATCATTC (193) | GAATGATGCCCAGGATT TT<u>CTT</u>GGCTTTCCTTTCT CG(194) |
| 5HT-1E | A290K | AGGGAACGGAAGGCA<u>AAA</u> CGCATCCTGGGGCT (195) | AGCCCCAGGATGCG<u>TTT</u> TGCCTTCCGTTCCCT (196) |
| 5HT-1F | A292K | CAAGAGAACGGAAAGCA<u>A</u> <u>AG</u>ACTACCCTGGGATTAAT C(197) | GATTAATCCCAGGGTAG TC<u>TTT</u>TGCTTTCCGTTCTC TTG(198) |
| 5HT-2B | S323K | AACGAACAGAGAGCC<u>AAA</u> AAGGTCCTAGGGATTG (199) | CAATCCCTAGGACC<u>TTT</u> <u>T</u>GGCTCTCTGTTCGTT (200) |
| 5HT-4A | A258K | GGACAGAGACCAAAGCA<u>A</u> <u>AG</u>AAGACCCTGTGCATC (201) | GATGCACAGGGTCTT<u>CTT</u> TGCTTTGGTCTCTGTCC (202) |
| 5HT-4B | A258K | GGACAGAGACCAAAGCA<u>A</u> <u>AG</u>AAGACCCTGTGCATC (203) | GATGCACAGGGTCTT<u>CTT</u> TGCTTTGGTCTCTGTCC (204) |
| 5HT-4C | A258K | GGACAGAGACCAAAGCA<u>A</u> <u>AG</u>AAGACCCTGTGCATC (205) | GATGCACAGGGTCTT<u>CTT</u> TGCTTTGGTCTCTGTCC (206) |
| 5HT-4D | A258K | GGACAGAGACCAAAGCA<u>A</u> <u>AG</u>AAGACCCTGTGCATC (207) | GATGCACAGGGTCTT<u>CTT</u> TGCTTTGGTCTCTGTCC (208) |

TABLE F-continued

| Receptor Identifier | Codon Mutation | 5'-3' orientation (sense), (SEQ.ID.NO.) mutation underlined | 5'-3' orientation (antisense) (SEQ.ID.NO.) |
|---|---|---|---|
| 5HT-4E | A258K | GGACAGAGACCAAAGCAA AGAAGACCCTGTGCATC (209) | GATGCACAGGGTCTTCTT TGCTTTGGTCTCTGTCC (210) |
| 5HT-5A | A284K | AAGGAGCAGCGGGCCAAG CTCATGGTGGGCATC (211) | GATGCCCACCATGAGCT TGGCCCGCTGCTCCTT (212) |
| 5HT-6 | S267K | CTGAAGGCCAAGCTTACGCT GGGCATCCTGCTGGGCA (213) | ATGCCCAGCGTAAGCTTG GCCTTCAGGGCCTTCCTG CT (214) |
| 5HT-7 | A326K | GAACAGAAAGCAAAGACCA CCCTGGGGATCATCGT (215) | CCCAGGGTGGTCTTTGCT TTCTGTTCTCGCTTAAA (216) |
| AVPR1A | V290K | GCCAAGATCCGCACGAAGA AGATGACTTTTGTGATCG (217) | CGATCACAAAAGTCATCT TCTTCGTGCGGATCTTGG C(218) |
| AVPR1B | V280K | GGCCAAGATCCGAACAAAG AAGATGACCTTTGTCATC (219) | CGATGACAAAGGTCATCT TCTTTGTTCGGATCTTGG CC (220) |
| AVPR2 | V270K | GCTGTGGCCAAGACTAAGA GGATGACGCTAGTG (221) | CACTAGCGTCATCCTCTT AGTCTTGGCCACAGC (222) |
| BBR3 | 270K | CGAAAGAGAATTAAAAGAA CGGTATTGGTGTTG (223) | AATACCGTTCTTTTAATT CTCTTTCGGGATTC (224) |
| BDKR1 | T249K | GCCGCAAGGATAGCAAGAC CAAAGCGCTGATCCTCAC (225) | GTGAGGATCAGCGCTTTG GTCTTGCTATCCTTGCGG C (226) |
| BDKR2 | T269K | CGGAGAGGAGGGCCAAGGT GCTAGTCCTGGT (227) | ACCAGGACTAGCACCTTG GCCCTCCTCTCCG (228) |
| C3a | F376K | CGCCAAGTCTCAGAGCAAA ACCAAGCGAGTGGCCGTGG TG (229) | CACCACGGCCACTCGCTT GGTTTTGCTCTGAGACTT GGCG (230) |
| C5a | L241K | CGGTCCACCAAGACAAAGA AGGTGGTGGTGGCA (231) | TGCCACCACCACCTTCTT TGTCTTGGTGGACCG (232) |
| CB1 | A342K | CGCATGGACATTAGGTTAA AGAAGACCCTGGTCCTGA (233) | TCAGGACCAGGGTCTTCT TTAACCTAATGTCCATGC G (234) |
| CB2 | A244K | GGCTGGATGTGAGGTTGAA GAAGACCCTAGGGCTAGTG (235) | CACTAGCCCTAGGGTCTT CTTCAACCTCACATCCAG CC (236) |
| CCR2b | V242K | GAAGAGGCATAGGGCAAAG AGAGTCATCTTCACC (237) | GGTGAAGATGACTCTCTT TGCCCTATGCCTCTTC (238) |
| CCR3 | I238K | GTAAAAAAAAGTACAAGGC CAAGCGGCTCATTTTTGTCA TC (239) | GATGACAAAAATGAGCC GCTTGGCCTTGTACTTTTT TTTAC (240) |
| CCR5 | V234K | GAAGAGGCACAGGGCTAAG AGGCTTATCTTCACCATC (241) | GATGGTGAAGATAAGCC TCTTAGCCCTGTGCCTCT TC (242) |
| CCR8 | I237K | CCACAACAAGACCAAGGCC AAGAGGTTGGTGCTCATTGT GG (243) | CCACAATGAGCACCAAC CTCTTGGCCTTGGTCTTG TTGTGG (244) |
| CCR9 | L253K | TCCAAGCACAAAGCCAAAA AAGTGACCATCACTGTCC (245) | GGACAGTGATGGTCACTT TTTTGGCTTTGTGCTTGG A (246) |

TABLE F-continued

| Receptor Identifier | Codon Mutation | 5'-3' orientation (sense), (SEQ.ID.NO.) mutation underlined | 5'-3' orientation (antisense) (SEQ.ID.NO.) |
| --- | --- | --- | --- |
| CRFR1 | T316P | GAAGGCTGTGAAAGCCCCTCTGGTGCTGCTGC (247) | GCAGCAGCACCAGAGGGCTTTCACAGCCTTC (248) |
| CXCR4 | L238K | AGAAGCGCAAGGCCAAGAAGACCACAGTCATCCTCA (249) | TGAGGATGACTGTGGTCTTCTTGGCCTTGCGCTTCT (250) |
| Dopamine D1 | L271K | GAGAAACTAAAGTCAAGAAGACTCTGTG (251) | CTCCTTCGGTCCTCCTATCGTTGTCAGAAGT (252) |
| Dopamine D2 | T372K | GAGAAGAAAGCCAATCAGATGCTCGCC (253) | GGCGAGCATCTGAGTGGCTTTCTTCTC (254) |
| Dopamine D3 | T328K | GAGAAGAAGGCAAAACAAATGGTGGCC (255) | GGCCACCATTTGTTTTGCCTTCTTCTC (256) |
| Dopamine D5 | L295K | AAGAAGGAGACCAAAGTTAAAAAGACCCTGTCG (257) | CGACAGGGTCTTTTTAACTTTGGTCTCCTTCTT (258) |
| ETA | A305K | CAGCGTCGAGAAGTGAAAAAAACAGTTTTCTGCTTGGTTGTA (259) | TACAACCAAGCAGAAAACTGTTTTTTTCACTTCTCGACGCTG (260) |
| ETB | A322K | CAGAGACGGGAAGTGAAGAAAACCGTCTTTTGCCTGG (261) | CCAGGCAAAAGACGGTTTTCTTCACTTCCCGTCTCTG (262) |
| FPR1 | L240K | AAGTCCAGTCGTCCCAAACGGGTCCTCTCCTT (263) | AAGGAGAGGACCCGTTTGGGACGACTGGACTT (264) |
| FPRL1 | L240K | AAATCCAGCCGTCCCAAACGGGTCCTCACTGC (265) | GCAGTGAGGACCCGTTTGGGACGGCTGGATTT (266) |
| GALR1 | A246K | CCAAGAAAAAGACTAAACAGACAGTTCTGG (267) | CTCCTTCGGTCCTCCTATCGTTGTCAGAAGT (252) |
| GALR2 | T235K | GCCAAGCGCAAGGTGAAACGCATGATCCTC (268) | GAGGATCATGCGTTTCACCTTGCGCTTGGCG (269) |
| GIP | T343P | AGGCTGGCTCGCTCCCCGCTGACGCTGGTGC (270) | GCACCAGCGTCAGCGGGGAGCGAGCCAGCCT (271) |
| mGluR1 | 3' Deletion | See alternative approach below | See alternative approach below |
| GPR5 | V224K | CGGCGCCACCGCACGAAAAAGCTCATCTTC (272) | CTCCTTCGGTCCTCCTATCGTTGTCAGAAGT (252) |
| GPR24 (also known as MCH or SLC-1) | T255K T255K/T257R 24-IC3-SST2 C305Y P271L W269C W269F W269L F265I I261Q D140N | See alternative approach below | See alternative approach below |
| GRPR | A263K | GGAAGCGACTTAAGAAGACAGTGCTGGTGTTT (273) | CAGCACTGTCTTCTTAAGTCGCTTCCGGGATTC (274) |
| M1 | A364K | AAGGAGAAGAAGGCGAAACGGACCCTGAGTGCC (275) | GGCACTCAGGGTCCGTTTCGCCTTCTTCTCCTT (276) |
| M2 | T386K | CCGGGAAAAGAAAGTCAAGAGGACAATCTTGGCT (277) | AGCCAAGATTGTCCTCTTGACTTTCTTTTCCCGG (278) |
| M3 | A490K | GGTCAAGGAGAAGAAAGCGAAACAGACCCTCAGTGCG (279) | CGCACTGAGGGTCTGTTTCGCTTTCTTCTCCTTGACC (280) |

TABLE F-continued

| Receptor Identifier | Codon Mutation | 5'-3' orientation (sense), (SEQ.ID.NO.) mutation underlined | 5'-3' orientation (antisense) (SEQ.ID.NO.) |
| --- | --- | --- | --- |
| M4 | T399K | GGGAGCGCAAAGTGAAACG AACGATCTTTGCC (281) | GGCAAAGATCGTTCGTTT CACTTTGCGCTCCC (282) |
| M5 | A441K | GTCAAAGAGAGGAAAGCAA AACAGACACTGAGTGCC (283) | GGCACTCAGTGTCTGTTT TGCTTTCCTCTCTTTGAC (284) |
| MC3 | A241K | GCAACACTCATGTATGAAG GGGAAAGTCACCATCACC (285) | CTCCTTCGGTCCTCCTAT CGTTGTCAGAAGT (252) |
| NK1R | V247K | GCCAAGCGCAAGGTGAAGA AAATGATGATTGTC (286) | GACAATCATCATTTTCTT CACCTTGCGCTTGGC (287) |
| NK2R | V249K | GCCAAGAAGAAGTTTAAGA AGACCATGGTGCT (288) | AGCACCATGGTCTTCTTA AACTTCTTCTTGGC (289) |
| NK3R | V298K | GGCCAAAAGAAAGGTTAAG AAAATGATGATTATTG (290) | CAATAATCATCATTTTCT TAACCTTTCTTTTGGCC (291) |
| NMBR | A265K | CACGGAAACGCCTGAAAAA AATTGTGCTTG (292) | CAAGCACAATTTTTTTCA GGCGTTTCCGTG (293) |
| NPY5 | F367K | GAATAAAAAAGAGATCACG AAGTGTTAAGTACAGACTG ACC (294) | GGTCAGTCTGTACTTAAC ACTTCGTGATCTCTTTTTT AT (295) |
| NTSR1 | V302K | GCCCTGCGGCACGGCAAGC GCGTCCTACGTGC (296) | GCACGTAGGACGCGCTTG CCGTGCCGCAGGGC (297) |
| NTSR2 | V269K | AGCCTCCAGCGCAGCAAGC AGGTTCTCAGAGCC (298) | GGCTCTGAGAACCTGCTT GCTGCGCTGGAGGCT (299) |
| OPRD | T260K | GCCTGCGGCGCATCAAGCG CATGGTGCTGGT (300) | ACCAGCACCATGCGCTTG ATGCGCCGCAGGC (301) |
| OPRL1 | T262K | ACCTGCGGCGCATCAAGCG GCTGGTGCTGGTG (302) | CACCAGCACCAGCCGCTT GATGCGCCGCAGGT (303) |
| OPRK | T273K | ACCTGCGTAGGATCAAGAG ACTGGTCCTGGTG (304) | CACCAGGACCAGTCTCTT GATCCTACGCAGGT (305) |
| OPRM | T281K | GGGAATCTTCGAAGGATCA AGAGGATGGTGCTGGTG (306) | CACCAGCACCATCCTCTT GATCCTTCGAAGATTCC (307) |
| OPRM1A | T281K | GGGAATCTTCGAAGGATCA AGAGGATGGTGCTGGTG (308) | CACCAGCACCATCCTCTT GATCCTTCGAAGATTCC (309) |
| OX$_I$R | A297K | CGGAGGAAGACAAAAAAGA TGCTGATGG (310) | CCATCAGCATCTTTTTTG TCTTCCTCCG (311) |
| OX$_2$R | A303K | CCAGAAGGAAAACAAAACG GATGTTGATG (312) | CTCCTTCGGTCCTCCTAT CGTTGTCAGAAGT (252) |
| PACAP | T355K | CGACTGGCCCGGTCCCCCT GCTGCTCATCC (313) | GGATGAGCAGCAGGGGG GACCGGGCCAGTCG (314) |
| PAF | L231K | GTCAAGCGCCGGGCGAAGT GGATGGTGTGCAC (315) | GTGCACACCATCCACTTC GCCCGGCGCTTGAC (316) |
| PGE EP1 | V296K | CACGACGTGGAGATGAAGG GCCAGCTTGTCGG (317) | CCGACAAGCTGGCCCTTC ATCTCCACGTCGTG (318) |
| PGE EP2 | L263K | GAGGAGACGGACCACAAGA TTCTCCTGGCTATCATG (319) | CATGATAGCCAGGAGAA TCTTGTGGTCCGTCTCCT C (320) |
| PGE EP4 | V271K | GCCGAGATCCAGATGAAGA TCTTACTCATTGCCACC (321) | GGTGGCAATGAGTAAGA TCTTCATCTGGATCTCGG C (322) |

TABLE F-continued

| Receptor Identifier | Codon Mutation | 5'-3' orientation (sense), (SEQ.ID.NO.) mutation underlined | 5'-3' orientation (antisense) (SEQ.ID.NO.) |
|---|---|---|---|
| PTHR1 | T410P | GGAAGCTGCTCAAATCCCC GCTGGTGCTCATGC (323) | GCATGAGCACCAGCGGG GATTTGAGCAGCTTCC (324) |
| PTHR2 | T365P | GGAAACTGGCCAAATCGCC ACTGGTCCTGGTCC (325) | GGACCAGGACCAGTGGC GATTTGGCCAGTTTCC (326) |
| SCTR | T344P | CGCCTGGCCAGGTCCCCTCT CCTGCTGATCC (327) | GGATCAGCAGGAGAGGG GACCTGGCCAGGCG (328) |
| SST1 | T270K | CGAGCGCAAGATCAAATTA ATGGTGATGG (329) | CTCCTTCGGTCCTCCTAT CGTTGTCAGAAGT (252) |
| SST2 | T255K | AGAAGAAGGTCAAACGAAT GGTGTCCATCGTG (330) | GGACACCATTCGTTTGAC CTTCTTCTCAGACT (331) |
| SST3 | T256K | GAACGCAGGGTCAAGCGCA TGGTGGTGGCC (332) | CTCCTTCGGTCCTCCTAT CGTTGTCAGAAGT (252) |
| SST4 | T258K | CGGAGAAGAAAATCAAAAG GCTGGTGCTG (333) | CTCCTTCGGTCCTCCTAT CGTTGTCAGAAGT (252) |
| SST5 | T247K | TCGGAGCGAAAGGTGAAGC GCATGGTGTTGGTGGT (334) | ACCATGCGCTTCACCTTT CGCTCCGAGCGCCGCCG (335) |
| TSHR | V509A D619G A623I A623K C672Y D619G/A623K V509A/C672Y V509A/A623K/C672Y | See alternative approach below | See alternative approach below |
| VIPR | T343P | AGGCTAGCCAGGTCCCCACT CCTGCTGATCC (336) | GGATCAGCAGGAGTGGG GACCTGGCTAGCCT (337) |
| VIPR2 | T330P | AGGCTGGCCAAGTCCCCGCT CCTGCTTATCC (338) | GGATAAGCAGGAGCGGG GACTTGGCCAGCCT (339) |

B. Alternative Approaches to Mutation 1. mGluR1

Preparation of a non-endogenous version of the human mGluR1 receptor was accomplished by deleting a portion of the intracellular region at the 3' end. The non-endogenous human mGluR1 was obtained by PCR using a template and rTth polymerase (Perkin Elmer) with the buffer system provided by the manufacturer. The cycle condition for the first round of PCR was as follows: 30 cycles of 94° C. for 1 min, 65° C. for 1 min and 72° C. for 1 min and 50 sec. The 5' PCR fragment contained a SalI site and was obtained utilizing hippocampus DNA as a template, and the following primer set:

(SEQ.ID.NO.:340)
5'-GCAGGCTGTCGACCTCGTCCTCACCACCATGGTC-3' and (SEQ.ID.NO.:341)
5'-AATGGGCTCACAGCCTGTTAGATCTGCATTGGGCCAC-3'.

The middle PCR fragment was obtained utilizing genomic DNA as a template, where the cycle condition was 30 cycles of 94° C. for 1 min, 65° C. for 1 min and 72° C. for 1 min and 50 sec, with the following primer set:

(SEQ.ID.NO.:342)
5'-TAACAGGCTGTGAGCCCATTCCTGTGCG-3' and (SEQ.ID.NO.:343)
5'-TTAGAATTCGCATTCCCTGCCCCTGCCTTCTTTC-3'.

The 3' PCR fragment was obtained by utilizing the endogenous mGluR1 clone as a co-template to obtain the full length cDNA using the pfu polymerase. The cycle condition for this PCR reaction was 30 cycles of 94° C. for 1 min, 65° C. for 2 min 30 sec and 72° C. for 1 min 30 sec. and the following primer set:

(SEQ.ID.NO.:344)
5'-TGCGAATTCTAATGGCAAGTCTGTGTCATGGTC-3' and (SEQ.ID.NO.:345)
5'-TGCGGATCCTCTTCGGAAGATGTTGAGGAAAGTG-3'.

(See, SEQ. ID. NO.:346 for nucleic acid sequence and SEQ. ID. NO.:347 for amino acid sequence).

2. GPR24 (MCH or SLC-1)

Preparation of non-endogenous versions of the human GPR24 receptor was accomplished by creating an T255K mutation (see, SEQ. ID. NO.:350 for nucleic acid sequence, SEQ. ID. NO.:351 for amino acid sequence), a T255K/T257R mutation (see, SEQ. ID. NO.:354 for nucleic acid sequence, SEQ. ID. NO.:355 for amino acid sequence), an 24-IC3-SST3 mutation (see, SEQ. ID. NO.:358 for nucleic acid sequence, SEQ. ID. NO.:359 for amino acid sequence), a C305Y mutation (see, SEQ. ID. NO.:362 for nucleic acid sequence, SEQ. ID. NO.:363 for amino acid sequence), a P271L mutation (see, SEQ. ID. NO.:366 for nucleic acid sequence, SEQ. ID. NO.:367 for amino acid sequence), a W269C mutation (see, SEQ. ID. NO.:370 for nucleic acid sequence, SEQ. ID. NO.:371 for amino acid sequence), a W269F mutation see, SEQ. ID. NO.:374 for nucleic acid sequence, SEQ. ID. NO.:375 for amino acid sequence), and a W269L mutation (see, SEQ. ID. NO.:378 for nucleic acid sequence, SEQ. ID. NO.:379 for amino acid sequence), a F265I mutation see, SEQ. ID. NO.:382 for nucleic acid sequence, SEQ. ID. NO.:383 for amino acid sequence), an I261Q mutation see, SEQ. ID. NO.:386 for nucleic acid sequence, SEQ. ID. NO.:387 for amino acid sequence), and a D140N mutation see, SEQ. ID. NO.:390 for nucleic acid sequence, SEQ. ID. NO.:391 for amino acid sequence).

A. T255K Mutation

Preparation of a non-endogenous version of the human GPR24 receptor was accomplished by creating an T255K mutation (see, SEQ. ID. NO.:350 for nucleic acid sequence, and SEQ. ID. NO.:351 for amino acid sequence). Mutagenesis was performed using Transformer Site-Directed Mutagenesis Kit (Clontech) according to the manufacturer. The PCR sense mutagenesis primer used had the following sequence: 5'-AGAGGGTGAAACGCACAGCCATCGCCATCTG-3' (SEQ. ID. NO.:348) and the antisense primer (selection marker) had the following sequence: 5'-CTCCTTCCGGTCCTCCTATCGTTGTCAGAAGT-3' (SEQ. ID. NO.:349). The endogenous GPR24 cDNA was used as a template.

B. T255K/T257R Mutation

Preparation of a non-endogenous version of the human GPR24 receptor was accomplished by creating an T255K/T257R mutation (see, SEQ. ID. NO.:354 for nucleic acid sequence, and SEQ. ID. NO.:355 for amino acid sequence). Mutagenesis was performed using QuikChange Site-Directed Mutagenesis Kit (Stratagene) according to the manufacturer. The PCR sense mutagenesis primer used had the following sequence: 5'-AGAGGGTGAAACGCAGAGCCATCGCCATCTG-3' (SEQ. ID. NO.:352) and the antisense primer had the following sequence: 5'-CAGATGGCGATGGCTCTGCGTTTCACCCTCT-3' (SEQ. ID. NO.:353). The endogenous GPR24 cDNA was used as a template.

C. 24-IC3-SST2 Mutation

Preparation of a non-endogenous version of the human GPR24 receptor was accomplished by creating a 24-IC3-SST2 mutation (see; SEQ. ID. NO.:358 for nucleic acid sequence, and SEQ. ID. NO.:359 for amino acid sequence). Blast result showed that GPR24 had the highest sequence homology to SST2. Thus the IC3 loop of GPR24 was replaced with that of SST2 to see if the chimera would show constitutive activity.

The BamHI-BstEII fragment containing IC3 of GPR24 was replaced with synthetic oligonucleotides that contained the IC3 of SST2. The PCR sense mutagenesis primer used had the following sequence:

5'-GATCCTGCAGAAGGTGAAGTCCTCTGGAATCCGAGTGGGCTCCTCTAAGAGGAAGAAGTCTGAGAAGAAG-3' (SEQ.ID.NO.:356)

and the antisense primer had the following sequence:

5'-GTGACCTTCTTCTCAGACTTCTTCCTCTTAGAGGAGCCCACTCGGATTCCAGAGGACTTCACCTTCTGCAG-3'. (SEQ.D.NO.:357)

The endogenous GPR24 cDNA was used as a template.

D. C305Y Mutation

Preparation of a non-endogenous version of the human GPR24 receptor was accomplished by creating an C305Y mutation (see, SEQ. ID. NO.:362 for nucleic acid sequence, and SEQ. ID. NO.:363 for amino acid sequence). Mutagenesis was performed using QuikChange Site-Directed Mutagenesis Kit (Stratagene) according to the manufacturer. The PCR sense mutagenesis primer used had the following sequence: 5'-GGCTATGCCAACAGCTACCTCAACCCCTTTGTG-3' (SEQ. ID. NO.:360) and the antisense primer had the following sequence: 5'-CACAAAGGGGTTGAGGTAGCTGTTGGCATAGCC-3' (SEQ. ID. NO.:361). The endogenous GPR24 cDNA was used as a template.

E. P271L Mutation

Preparation of a non-endogenous version of the human GPR24 receptor was accomplished by creating an P271L mutation (see, SEQ. ID. NO.:366 for nucleic acid sequence, and SEQ. ID. NO.:367 for amino acid sequence). Mutagenesis was performed using QuikChange Site-Directed Mutagenesis Kit (Stratagene) according to the manufacturer. The PCR sense mutagenesis primer used had the following sequence: 5'-TTGTGTGCTGGGCACTCTACTATGTGCTACAGC-3' (SEQ. ID. NO.:364) and the antisense primer had the following sequence: 5'-GCTGTAGCACATAGTAGAGTGCCCAGCACACAA-3' (SEQ. ID. NO.:365). The endogenous GPR24 cDNA was used as a template.

F. W269C Mutation

Preparation of a non-endogenous version of the human GPR24 receptor was accomplished by creating an W269C mutation (see, SEQ. ID. NO.:370 for nucleic acid sequence, and SEQ. ID. NO.:371 for amino acid sequence). Mutagenesis was performed using QuikChange Site-Directed Mutagenesis Kit (Stratagene) according to the manufacturer. The PCR sense mutagenesis primer used had the following sequence: 5'-GGTCTTCTTTGTGTGCTGCGCACCCTACTATGTG-3' (SEQ. ID. NO.:368) and the antisense primer had the following sequence: 5'-CACATAGTAGGGTGCGCAGCACACAAAGAAGACC-3' (SEQ. ID. NO.:369). The endogenous GPR24 cDNA was used as a template.

G. W269F Mutation

Preparation of a non-endogenous version of the human GPR24 receptor was accomplished by creating an W269F mutation (see, SEQ. ID. NO.:374 for nucleic acid sequence, and SEQ. ID. NO.:375 for amino acid sequence). Mutagenesis was performed using QuikChange Site-Directed Mutagenesis Kit (Stratagene) according to the manufacturer. The PCR sense mutagenesis primer used had the following sequence: 5'-GGTCTTCTTTGTGTGC TTCGCACCCTACTATGTG-3' (SEQ. ID. NO.:372) and the antisense primer had the following sequence: 5'-CACATAGTAGGGTGC GAAGCACACAAAGAAGACC-3' (SEQ. ID. NO.:373). The endogenous GPR24 cDNA was used as a template.

H. W269L Mutation

Preparation of a non-endogenous version of the human GPR24 receptor was accomplished by creating an W269L mutation (see, SEQ. ID. NO.:378 for nucleic acid sequence, and SEQ. ID. NO.:379 for amino acid sequence). Mutagenesis was performed using QuikChange Site-Directed Mutagenesis Kit (Stratagene) according to the manufacturer. The PCR sense mutagenesis primer used had the following sequence: 5'-GGTCTTCTTTGTGTGC TTGGCACCCTACTATGTG-3' (SEQ. ID. NO.:376) and the antisense primer had the following sequence: 5'-CACATAGTAGGGTGC CAAGCACACAAAGAAGACC-3' (SEQ. ID. NO.:377). The endogenous GPR24 cDNA was used as a template.

I. F265I Mutation

Preparation of a non-endogenous version of the human GPR24 receptor was accomplished by creating an F265 I mutation (see, SEQ. ID. NO.:382 for nucleic acid sequence, and SEQ. ID. NO.:383 for amino acid sequence). Mutagenesis was performed using QuikChange Site-Directed Mutagenesis Kit (Stratagene) according to the manufacturer. The PCR sense mutagenesis primer used had the following sequence: 5'-GCCATCTGTCTGGTC ATCTTTGTGTGCTGGG-3' (SEQ. ID. NO.:380) and the antisense primer had the following sequence: 5'-CCCAGCACACAAAGATGACCAGACAGATGGC-3' (SEQ. ID. NO.:381). The endogenous GPR24 cDNA was used as a template.

J. I261Q Mutation

Preparation of a non-endogenous version of the human GPR24 receptor was accomplished by creating an I 261Q mutation (see, SEQ. ID. NO.:386 for nucleic acid sequence, and SEQ. ID. NO.:387 for amino acid sequence). Mutagenesis was performed using QuikChange Site-Directed Mutagenesis Kit (Stratagene) according to the manufacturer. The PCR sense mutagenesis primer used had the following sequence: 5'-CGCACAGCCATCGCC CAGTGTCTGGTCTTCTTTGTG-3' (SEQ. ID. NO.:384) and the antisense primer had the following sequence: 5'-CACAAAGAAGACCAGACA CTGGGCGATGGCTGTGCG-3' (SEQ. ID. NO.:385). The endogenous GPR24 cDNA was used as a template.

K. D140N Mutation

Preparation of a non-endogenous version of the human GPR24 receptor was accomplished by creating an D140N mutation (see, SEQ. ID. NO.:390 for nucleic acid sequence, and SEQ. ID. NO.:391 for amino acid sequence). Mutagenesis was performed using QuikChange Site-Directed Mutagenesis Kit (Stratagene) according to the manufacturer. The PCR sense mutagenesis primer used had the following sequence: 5'-ACCGCCATGGCCATT AACGCGTACCTGGCCACT-3' (SEQ. ID. NO.:388) and the antisense primer had the following sequence: 5'-AGTGGCCAGGTAGCG GTTAATGGCCATGGCGGT-3' (SEQ. ID. NO.:389). The endogenous GPR24 cDNA was used as a template.

3. TSHR

Preparation of non-endogenous versions of the human TSHR receptor were accomplished by creating an V509A mutation (see, SEQ. ID. NO.:394 for nucleic acid sequence, SEQ. ID. NO.:395 for amino acid sequence), a D619G mutation (see, SEQ. ID. NO.:398 for nucleic acid sequence, SEQ. ID. NO.:399 for amino acid sequence), an A623I mutation (see, SEQ. ID. NO.:402 for nucleic acid sequence, SEQ. ID. NO.:403 for amino acid sequence), a A623K mutation (see, SEQ. ID. NO.:406 for nucleic acid sequence, SEQ. ID. NO.:407 for amino acid sequence), an C672Y mutation (see, SEQ. ID. NO.:410 for nucleic acid sequence, SEQ. ID. NO.:411 for amino acid sequence), a D619G/A623K mutation (see, SEQ. ID. NO.:414 for nucleic acid sequence, SEQ. ID. NO.:415 for amino acid sequence), an V509A/C672Y mutation see, SEQ. ID. NO.:418 for nucleic acid sequence, SEQ. ID. NO.:419 for amino acid sequence), and an V509A/A623K/C672Y mutation (see, SEQ. ID. NO.:422 for nucleic acid sequence, SEQ. ID. NO.:423 for amino acid sequence).

A. V509A Mutation

Preparation of a non-endogenous version of the human TSHR receptor was accomplished by creating an V509A mutation (see, SEQ. ID. NO.:394 for nucleic acid sequence, and SEQ. ID. NO.:395 for amino acid sequence). Mutagenesis was performed using QuikChange Site-Directed Mutagenesis Kit (Stratagene) according to the manufacturer. The PCR sense mutagenesis primer used had the following sequence: 5'-CAAGCGAGTTATCG GCATATACGCTGACGGTC-3' (SEQ. ID. NO.:392) and the antisense primer had the following sequence: 5'-GACCGTCAGCGTATATGCCGATAACTCGCTTG-3' (SEQ. ID. NO.:393). The endogenous TSHR cDNA was used as a template. This V509A mutant can be differentiated from the endogenous version by the absence of an AccI site near the mutation site.

B. D619G Mutation

Preparation of a non-endogenous version of the human TSHR receptor was also accomplished by creating a D619G mutation (see, SEQ. ID. NO.:398 for nucleic acid sequence, and SEQ. ID. NO.:399 for amino acid sequence). Mutagenesis was performed using QuikChange Site-Directed Mutagenesis Kit (Stratagene) according to the manufacturer. The PCR sense mutagenesis primer used had the following sequence: 5'-ACCCAGGGGACAAA GGTACCAAAATTGCCAA-3' (SEQ. ID. NO.:396) and the antisense primer had the following sequence: 5'-TTGGCAATTTTGGTACCTTTGTCCCCTGGGT-3' (SEQ. ID. NO.:397). The endogenous TSHR cDNA was used as a template. This D619G mutant can be differentiated from the endogenous version by the presence of a KpnI site near the mutation site.

C. A623I Mutation

Preparation of a non-endogenous version of the human TSBR was accomplished by creating an A623I mutation (see, SEQ. ID. NO.:402 for nucleic acid sequence, and SEQ. ID. NO.:403 for amino acid sequence). Mutagenesis was performed using QuikChange Site-Directed Mutagenesis Kit (Stratagene) according to the manufacturer. The PCR sense mutagenesis primer used had the following sequence: 5'-AAAGATACCAAAATTATCAAGAGGATGGCTGT-3' (SEQ. ID. NO.:400) and the antisense primer had the following sequence: 5'-ACAGCCATCCTCTT GATAATTTTGGTATCTTT-3' (SEQ. ID. NO.:401). The endogenous TSHR cDNA was used as a template. This A623I mutant can be differentiated from the endogenous version by the absence of a BstXI site near the mutation site.

D. A623K Mutation

Preparation of a non-endogenous version of the human TSHR receptor was also accomplished by creating a A623K mutation (see, SEQ. ID. NO.:406 for nucleic acid sequence, and SEQ. ID. NO.:407 for amino acid sequence). Mutagenesis was performed using QuikChange Site-Directed Mutagenesis Kit (Stratagene) according to the manufacturer. The PCR sense mutagenesis primer used had the following sequence: 5'-AAAGATACCAAAATT AAGAAGAGGATGGCTGTG-3' (SEQ. ID. NO.:404) and the antisense primer had the following sequence: 5'-CACAGCCATCCTCTTCTTAATTTTGGTATCTTT-3' (SEQ. ID. NO.:405). The endogenous TSHR cDNA was used as a template. This A623K mutant can be differentiated from the endogenous version by the absence of a BstXI site near the mutation site.

E. C672Y Mutation

Preparation of a non-endogenous version of the human TSHR receptor was also accomplished by creating a C672Y mutation (see, SEQ. ID. NO.:410 for nucleic acid sequence, and SEQ. ID. NO.:411 for amino acid sequence). Mutagenesis was performed using QuikChange Site-Directed Mutagenesis Kit (Stratagene) according to the manufacturer. The PCR sense mutagenesis primer used had the following sequence: 5'-CTATCCACTTAACTCG TACGCCAATCCATTCCTC-3' (SEQ. ID. NO.:408) and the antisense primer had the following sequence: 5'-GAGGAATGGATTGGC GTACGAGTTAAGTGGATAG-3' (SEQ. ID. NO.:409). The endogenous TSIR cDNA was used as a template. This C672Y mutant can be differentiated from the endogenous version by the presence of a BsiWI site near the mutation site.

F. D619G/A623K Mutation

Preparation of a non-endogenous version of the human TSHR receptor was also accomplished by creating a D619G/A623K mutation (see, SEQ. ID. NO.:414 for nucleic acid sequence, and SEQ. ID. NO.:415 for amino acid sequence). Mutagenesis was performed using QuikChange Site-Directed Mutagenesis Kit (Stratagene) according to the manufacturer. The PCR sense mutagenesis primer used had the following sequence:

(SEQ.ID.NO.:412)
5'-ACCCAGGGGACAAAGGTACCAAAATTAAGAAGAGGATGGCTGTG-3' and the antisense primer had the following sequence: 5'-CACAGCCATCCTCTTCTTAATTTTGGT ACCTTTGTCCCCTGGGT-3' (SEQ. ID. NO.:413). The non-endogenous D619G mutant version of TSHR cDNA was used as a template. This D619G/A623K mutant can be differentiated from the endogenous version by the presence of a KpnI site near the D619G mutation site and absence of a BstXI site near the A623K mutation site.

G. V509A/C672Y Mutation

Preparation of a non-endogenous version of the human TSHR receptor was also accomplished by creating a V509A/C672Y mutation (see, SEQ. ID. NO.:418 for nucleic acid sequence, and SEQ. ID. NO.:419 for amino acid sequence). Mutagenesis was performed using QuikChange Site-Directed Mutagenesis Kit (Stratagene) according to the manufacturer. The V509A sense mutagenesis primer used had the following sequence: 5'-CAAGCGAGTTATCGGC ATATACGCTGACGGTC-3' (SEQ. ID. NO.:416) and the C672Y antisense primer had the following sequence: 5'-GAGGAATGGATTGGCGTACGAGTTAAGT GGATAG-3' (SEQ. ID. NO.:417). The endogenous TSHR cDNA was used as a template. This V509A/C672Y mutant can be differentiated from the endogenous version by the absence of an AccI site near the V509A mutation site and presence of a BsiWI site near the C672Y mutation site.

H. V509A/A623K/C672Y Mutation

Preparation of a non-endogenous version of the human TSHR receptor was also accomplished by creating a V509A/A623K/C672Y mutation (see, SEQ. ID. NO.:422 for nucleic acid sequence, and SEQ. ID. NO.:423 for amino acid sequence). Mutagenesis was performed using QuikChange Site-Directed Mutagenesis Kit (Stratagene) according to the manufacturer. The A623K sense mutagenesis primer used had the following sequence: 5'-AAAGATACCAAAATTAAGAAGAGGATGGCTGTG-3' (SEQ. ID. NO.:420) and the A623K antisense primer had the following sequence: 5'-CACAGCCATCCTCTTCTTAATTTTGGTATCTTT-3' (SEQ. ID. NO.:421). The non-endogenous V509A/C672Y mutant version of TSHR cDNA was used as a template. This V509A/A623K/C672Y mutant can be differentiated from the endogenous version by the absence of an AccI site near the V509A mutation site, absence of a BstXI near the A623K mutation site and the presence of a BsiWI site near the C672Y mutation 10 site.

The non-endogenous human GPCRs were then sequenced and the derived and verified nucleic acid and amino acid sequences are listed in the accompanying "Sequence Listing" appendix to this patent document, as summarized in Table G below:

TABLE G

| Mutated GPCR | Nucleic Acid Sequence Listing | Amino Acid Sequence Listing |
| --- | --- | --- |
| 5HT-1A V343K | SEQ.ID.NO.:424 | SEQ.ID.NO.:425 |
| 5HT-1B T313K | SEQ.ID.NO.:426 | SEQ.ID.NO.:427 |
| 5HT-1D T300K | SEQ.ID.NO.:428 | SEQ.ID.NO.:429 |
| 5HT-1E A290K | SEQ.ID.NO.:430 | SEQ.ID.NO.:431 |
| 5HT-1F A292K | SEQ.ID.NO.:432 | SEQ.ID.NO.:433 |
| 5HT-2B S323K | SEQ.ID.NO.:434 | SEQ.ID.NO.:435 |
| 5HT-4A A258K | SEQ.ID.NO.:436 | SEQ.ID.NO.:437 |
| 5HT-4B A258K | SEQ.ID.NO.:438 | SEQ.ID.NO.:439 |
| 5HT-4C A258K | SEQ.ID.NO.:440 | SEQ.ID.NO.:441 |
| 5HT-4D A258K | SEQ.ID.NO.:442 | SEQ.ID.NO.:443 |
| 5HT-4E A258K | SEQ.ID.NO.:444 | SEQ.ID.NO.:445 |
| 5HT-5A A284K | SEQ.ID.NO.:446 | SEQ.ID.NO.:447 |
| 5HT-6 S267K | SEQ.ID.NO.:448 | SEQ.ID.NO.:449 |
| 5HT-7 A326K | SEQ.ID.NO.:450 | SEQ.ID.NO.:451 |
| AVPR1A V290K | SEQ.ID.NO.:452 | SEQ.ID.NO.:453 |
| AVPR1B V280K | SEQ.ID.NO.:454 | SEQ.ID.NO.:455 |
| AVPR2 V270K | SEQ.ID.NO.:456 | SEQ.ID.NO.:457 |
| BBR3 A270K | SEQ.ID.NO.:458 | SEQ.ID.NO.:459 |
| BDKR1 T249K | SEQ.ID.NO.:460 | SEQ.ID.NO.:461 |
| BDKR2 T269K | SEQ.ID.NO.:462 | SEQ.ID.NO.:463 |
| C3a F376K | SEQ.ID.NO.:464 | SEQ.ID.NO.:465 |

TABLE G-continued

| Mutated GPCR | Nucleic Acid Sequence Listing | Amino Acid Sequence Listing |
|---|---|---|
| C5a L241K | SEQ.ID.NO.:466 | SEQ.ID.NO.:467 |
| CB1 A342K | SEQ.ID.NO.:468 | SEQ.ID.NO.:469 |
| CB2 A244K | SEQ.ID.NO.:470 | SEQ.ID.NO.:471 |
| CCR2b V242K | SEQ.ID.NO.:472 | SEQ.ID.NO.:473 |
| CCR3 I238K | SEQ.ID.NO.:474 | SEQ.ID.NO.:475 |
| CCR5 V234K | SEQ.ID.NO.:476 | SEQ.ID.NO.:477 |
| CCR8 I237K | SEQ.ID.NO.:478 | SEQ.ID.NO.:479 |
| CCR9 L253K | SEQ.ID.NO.:480 | SEQ.ID.NO.:481 |
| CRFR1 T316P | SEQ.ID.NO.:482 | SEQ.ID.NO.:483 |
| CXCR4 L238K | SEQ.ID.NO.:484 | SEQ.ID.NO.:485 |
| Dopamine D1 L271K | SEQ.ID.NO.:486 | SEQ.ID.NO.:487 |
| Dopamine D2 T372K | SEQ.ID.NO.:488 | SEQ.ID.NO.:489 |
| Dopamine D3 T328K | SEQ.ID.NO.:490 | SEQ.ID.NO.:491 |
| Dopamine D5 L295K | SEQ.ID.NO.:492 | SEQ.ID.NO.:493 |
| ETA A305K | SEQ.ID.NO.:494 | SEQ.ID.NO.:495 |
| ETB A322K | SEQ.ID.NO.:496 | SEQ.ID.NO.:497 |
| FPR1 L240K | SEQ.ID.NO.:498 | SEQ.ID.NO.:499 |
| FPRL1 L240K | SEQ.ID.NO.:500 | SEQ.ID.NO.:501 |
| GALR1 A246K | SEQ.ID.NO.:502 | SEQ.ID.NO.:503 |
| GALR2 T235K | SEQ.ID.NO.:504 | SEQ.ID.NO.:505 |
| GIP T343P | SEQ.ID.NO.:506 | SEQ.ID.NO.:507 |
| mGluR1 3' Deletion | SEQ.ID.NO.:346 | SEQ.ID.NO.:347 |
| GPR5 V224K | SEQ.ID.NO.:508 | SEQ.ID.NO.:509 |
| GPR24 (also known as MCH or SLC-1) | | |
| T255K | SEQ.ID.NO.:350 | SEQ.ID.NO.:351 |
| T255K/T257R | SEQ.ID.NO.:354 | SEQ.ID.NO.:355 |
| 24-IC3-SST2 | SEQ.ID.NO.:358 | SEQ.ID.NO.:359 |
| C305Y | SEQ.ID.NO.:362 | SEQ.ID.NO.:363 |
| P271L | SEQ.ID.NO.:366 | SEQ.ID.NO.:367 |
| W269C | SEQ.ID.NO.:370 | SEQ.ID.NO.:371 |
| W269F | SEQ.ID.NO.:374 | SEQ.ID.NO.:375 |
| W269L | SEQ.ID.NO.:378 | SEQ.ID.NO.:379 |
| F265I | SEQ.ID.NO.:382 | SEQ.ID.NO.:383 |
| I261Q | SEQ.ID.NO.:386 | SEQ.ID.NO.:387 |
| D140N | SEQ.ID.NO.:390 | SEQ.ID.NO.:391 |
| GRPR A263K | SEQ.ID.NO.:510 | SEQ.ID.NO.:511 |
| M1 A364K | SEQ.ID.NO.:512 | SEQ.ID.NO.:513 |
| M2 T386K | SEQ.ID.NO.:514 | SEQ.ID.NO.:515 |
| M3 A490K | SEQ.ID.NO.:516 | SEQ.ID.NO.:517 |
| M4 T399K | SEQ.ID.NO.:518 | SEQ.ID.NO.:519 |
| M5 A441K | SEQ.ID.NO.:520 | SEQ.ID.NO:521 |
| MC3 A241K | SEQ.ID.NO.:522 | SEQ.ID.NO.:523 |
| NK1R V247K | SEQ.ID.NO.:524 | SEQ.ID.NO.:525 |
| NK2R V249K | SEQ.ID.NO.:526 | SEQ.ID.NO.:527 |
| NK3R V298K | SEQ.ID.NO.:528 | SEQ.ID.NO.:529 |
| NMBR A265K | SEQ.ID.NO.:530 | SEQ.ID.NO.:531 |
| NPY5 A297K | SEQ.ID.NO.:532 | SEQ.ID.NO.:533 |
| NTSR1 V302K | SEQ.ID.NO.:534 | SEQ.ID.NO.:535 |
| NTSR2 V269K | SEQ.ID.NO.:536 | SEQ.ID.NO.:537 |
| OPRD T260K | SEQ.ID.NO.:538 | SEQ.ID.NO.:539 |
| OPRL1 T262K | SEQ.ID.NO.:540 | SEQ.ID.NO.:541 |
| OPRK T273K | SEQ.ID.NO.:542 | SEQ.ID.NO.:543 |
| OPRM T281K | SEQ.ID.NO.:544 | SEQ.ID.NO.:545 |
| OPRM1A T281K | SEQ.ID.NO.:546 | SEQ.ID.NO.:547 |
| $OX_1R$ F367K | SEQ.ID.NO.:548 | SEQ.ID.NO.:549 |
| $OX_2R$ A297K | SEQ.ID.NO.:550 | SEQ.ID.NO.:551 |
| PACAP T355K | SEQ.ID.NO.:552 | SEQ.ID.NO.:553 |
| PAF L231K | SEQ.ID.NO.:554 | SEQ.ID.NO.:555 |
| PGE EP1 V296K | SEQ.ID.NO.:556 | SEQ.ID.NO.:557 |
| PGE EP2 L263K | SEQ.ID.NO.:558 | SEQ.ID.NO.:559 |
| PGE EP4 V271K | SEQ.ID.NO.:560 | SEQ.ID.NO.:561 |
| PTHR1 T410P | SEQ.ID.NO.:562 | SEQ.ID.NO.:563 |
| PTHR2 T365P | SEQ.ID.NO.:564 | SEQ.ID.NO.:565 |
| SCTR T344P | SEQ ID.NO.:566 | SEQ.ID.NO.:567 |
| SST1 T290K | SEQ.ID.NO.:568 | SEQ.ID.NO.:569 |
| SST2 T255K | SEQ.ID.NO.:570 | SEQ.ID.NO.:571 |
| SST3 T256K | SEQ.ID.NO.:572 | SEQ.ID.NO.:573 |
| SST4 T258K | SEQ.ID.NO.:574 | SEQ.ID.NO.:575 |
| SST5 T247K | SEQ.ID.NO.:576 | SEQ.ID.NO.:577 |
| TSHR | | |
| V509A | SEQ.ID.NO.:394 | SEQ.ID.NO.:395 |
| D619G | SEQ.ID.NO.:398 | SEQ.ID.NO.:399 |
| A623I | SEQ.ID.NO.:402 | SEQ.ID.NO.:403 |
| A623K | SEQ.ID.NO.:406 | SEQ.ID.NO.:407 |
| C672Y | SEQ.ID.NO.:410 | SEQ.ID.NO.:411 |
| D619G/A623K | SEQ.ID.NO.:414 | SEQ.ID.NO.:415 |
| V509A/C672Y | SEQ.ID.NO.:418 | SEQ.ID.NO.:419 |
| V509A/A623K1C672Y | SEQ.ID.NO.:422 | SEQ ID.NO.:423 |
| VIPR T343P | SEQ.ID.NO.:578 | SEQ.ID.NO.:579 |
| VIPR2 T330P | SEQ.ID.NO.:580 | SEQ.ID.NO.:581 |

Assessment of constitutive activity of the non-endogenous versions of the known GPCRs can then be accomplished.

Example 3

Receptor Expression

Although a variety of cells are available to the art for the expression of proteins, it is most preferred that mammalian cells be utilized. The primary reason for this is predicated upon practicalities, i.e., utilization of, e.g., yeast cells for the expression of a GPCR, while possible, introduces into the protocol a non-mammalian cell which may not (indeed, in the case of yeast, does not) include the receptor-coupling, genetic-mechanism and secretary pathways that have evolved for mammalian systems—thus, results obtained in non-mammalian cells, while of potential use, are not as preferred as that obtained from mammalian cells. Of the mammalian cells, COS-7, Hek-293 and Hek-293T cells are particularly preferred, although the specific mammalian cell utilized can be predicated upon the particular needs of the artisan. The following approach was used for the indicated receptors, and can also be applied with respect to other receptors disclosed herein.

On day one, $2\times10^4$ Hek-293T cells well were plated out. On day two, two reaction tubes were prepared (the proportions to follow for each tube are per plate): tube A was prepared by mixing 20 $\mu$g DNA (e.g., pCMV vector; pCMV vector with receptor cDNA, etc.) in 1.2 ml serum free DMEM (Irvine Scientific, Irvine, Calif.); tube B was prepared by mixing 120 $\mu$l lipofectamine (Gibco BRL) in 1.2 ml serum free DMEM. Tubes A and B were admixed by inversions (several times), followed by incubation at room temperature for 30–45 min. The admixture is referred to as the "transfection mixture". Plated Hek-293T cells were washed with 1×PBS, followed by addition of 10 ml serum free DMEM. 2.4 ml of the transfection mixture were added to the cells, followed by incubation for 4 hrs at 37° C./5% $CO_2$. The transfection mixture was removed by aspiration, followed by the addition of 25 ml of DMEM/10% Fetal Bovine Serum. Cells were incubated at 37° C./5% $CO_2$. After 72 hr incubation, cells were harvested and utilized for analysis.

Example 4

Assays for Determination of Constitutive Activity of Non-Endogenous GPCRS

A variety of approaches are available for assessment of constitutive activity of the non-endogenous versions of known GPCRs. The following are illustrative; those of ordinary skill in the art are credited with the ability to determine those techniques that are preferentially beneficial for the needs of the artisan.

1. Membrane Binding Assays: [$^{35}$S]GTP$\gamma$S Assay

When a G protein-coupled receptor is in its active state, either as a result of ligand binding or constitutive activation, the receptor couples to a G protein and stimulates the release of GDP and subsequent binding of GTP to the G protein. The alpha subunit of the G protein-receptor complex acts as a GTPase and slowly hydrolyzes the GTP to GDP, at which point the receptor normally is deactivated. Constitutively activated receptors continue to exchange GDP for GTP. The non-hydrolyzable GTP analog, [$^{35}$S]GTP$\gamma$S, can be utilized to demonstrate enhanced binding of [$^{35}$S]GTP$\gamma$S to membranes expressing constitutively activated receptors. The advantage of using [$^{35}$S]GTP$\gamma$S binding to measure constitutive activation is that: (a) it is generically applicable to all G protein-coupled receptors; (b) it is proximal at the membrane surface making it less likely to pick-up molecules which affect the intracellular cascade.

The assay utilizes the ability of G protein coupled receptors to stimulate [$^{35}$S]GTP$\gamma$S binding to membranes expressing the relevant receptors. The assay can, therefore, be used in the direct identification method to screen candidate compounds to known, and constitutively activated G protein-coupled receptors. The assay is generic and has application to drug discovery at all G protein-coupled receptors.

The [$^{35}$S]GTP$\gamma$S assay can be incubated in 20 mM HEPES and between 1 and about 20 mM $MgCl_2$ (this amount can be adjusted for optimization of results, although 20 mM is preferred) pH 7.4, binding buffer with between about 0.3 and about 1.2 nM [$^{35}$S]GTP$\gamma$S (this amount can be adjusted for optimization of results, although 1.2 is preferred) and 12.5 to 75 $\mu$g membrane protein (e.g. COS-7 cells expressing the receptor; this amount can be adjusted for optimization, although 75 $\mu$g is preferred) and 1 $\mu$M GDP (this amount can be changed for optimization) for 1 hour. Wheatgerm agglutinin beads (25 $\mu$l; Amersham) should then be added and the mixture incubated for another 30 minutes at room temperature. The tubes are then centrifuged at 1500×g for 5 minutes at room temperature and then counted in a scintillation counter.

A less costly but equally applicable alternative has been identified which also meets the needs of large scale screening. FLASH PLATES™ and WALLAC™ scintistrips may be utilized to format a high throughput [$^{35}$S]GTP$\gamma$S binding assay. Furthermore, using this technique, the assay can be utilized for known GPCRs to simultaneously monitor tritiated ligand binding to the receptor at the same time as monitoring the efficacy via [$^{35}$S]GTP$\gamma$S binding. This is possible because the Wallac beta counter can switch energy windows to look at both tritium and $^{35}$S-labeled probes. This assay may also be used to detect other types of membrane activation events resulting in receptor activation. For example, the assay may be used to monitor $^{32}$P phosphorylation of a variety of receptors (both G protein coupled and tyrosine kinase receptors). When the membranes are centrifuged to the bottom of the well, the bound [$^{35}$S]GTP$\gamma$S or the $^{32}$P-phosphorylated receptor will activate the scintillant which is coated of the wells. Scinti® strips (Wallac) have been used to demonstrate this principle. In addition, the assay also has utility for measuring ligand binding to receptors using radioactively labeled ligands. In a similar manner, when the radiolabeled bound ligand is centrifuged to the bottom of the well, the scintistrip label comes into proximity with the radiolabeled ligand resulting in activation and detection.

2. Membrane-Based cAMP

A FLASH PLATE™ Adenylyl Cyclase kit (New England Nuclear; Cat. No. SMP004A) designed for cell-based assays can be modified for use with crude plasma membranes. The Flash Plate wells contain a scintillant coating which also contains a specific antibody recognizing cAMP. The cAMP generated in the wells was quantitated by a direct competition for binding of radioactive cAMP tracer to the cAMP antibody. The following serves as a brief protocol for the measurement of changes in cAMP levels in membranes that express the receptors.

Transfected cells are harvested approximately three days after transfection. Membranes were prepared by homogenization of suspended cells in buffer containing 20 mM HEPES, pH 7.4 and 10 mM $MgCl_2$. Homogenization is performed on ice using a Brinkman POLYTRON™ for approximately 10 seconds. The resulting homogenate is centrifuged at 49,000×g for 15 minutes at 4° C. The resulting pellet is then resuspended in buffer containing 20 mM HEPES, pH 7.4 and 0.1 mM EDTA, homogenized for 10 seconds, followed by centrifugation at 49,000×g for 15 minutes at 4° C. The resulting pellet can be stored at −80° C. until utilized. On the day of measurement, the membrane pellet is slowly thawed at room temperature, resuspended in buffer containing 20 mM HEPES, pH 7.4 and 10 mM $MgCl_2$ (these amounts can be optimized, although the values listed herein are preferred), to yield a final protein concentration of 0.60 mg/ml (the resuspended membranes were placed on ice until use).

cAMP standards and Detection Buffer (comprising 2 μCi of tracer [$^{125}$I cAMP (100 μl)] to 11 ml Detection Buffer) are prepared and maintained in accordance with the manufacturer's instructions. Assay Buffer is prepared fresh for screening and contained 20 mM HEPES, pH 7.4, 10 mM $MgCl_2$, 20 mM (Sigma), 0.1 units/ml creatine phosphokinase (Sigma), 50 μM GTP (Sigma), and 0.2 mM ATP (Sigma); Assay Buffer can be stored on ice until utilized. The assay is initiated by the addition of 50 μL of assay buffer followed by addition of 50 μL of membrane suspension to the NEN Flash Plate. The resultant assay mixture is incubated for 60 minutes at room temperature followed by addition of 100 μL of detection buffer. Plates are then incubated an additional 2–4 hours followed by counting in a Wallac MicroBeta™ scintillation counter. Values of cAMP/well are extrapolated from a standard cAMP curve that is contained within each assay plate.

3. Cell-Based cAMP for Gi Coupled Target GPCRs

TSHR is a Gs coupled GPCR that causes the accumulation of cAMP upon activation. TSHR was constitutively activated by mutating amino acid residue 623 (i.e., changing an alanine residue to an isoleucine residue). See, SEQ. ID. NO.:402 for nucleic acid sequence and SEQ. ID. NO.:403 for deduced amino acid sequence. A Gi coupled receptor is expected to inhibit adenylyl cyclase, and, therefore, decrease the level of cAMP production, which can make assessment of cAMP levels challenging. An effective technique for measuring the decrease in production of cAMP as an indication of constitutive activation of a Gi coupled receptor can be accomplished by co-transfecting, most preferably, non-endogenous, constitutively activated TSHR (TSHR-A623I) (or an endogenous, constitutively active Gs coupled receptor) as a "signal enhancer" with a Gi linked target GPCR, such as GPR24, to establish a baseline level of cAMP. Upon creating a non-endogenous version of the Gi coupled receptor, this non-endogenous version of the target GPCR is then co-transfected with the signal enhancer, and it is this material that can be used for screening. We utilized such approach to effectively generate a signal when a cAMP assay is used; this approach is preferably used in the direct identification of candidate compounds against Gi coupled receptors. It is noted that for a Gi coupled GPCR, when this approach is used, an inverse agonist of the target GPCR will increase the cAMP signal and an agonist will decrease the cAMP signal.

On day one, $2 \times 10^4$ Hek-293 and Hek-293T cells/well were plated out. On day two, two reaction tubes were prepared (the proportions to follow for each tube are per plate): tube A was prepared by mixing 2 μg DNA of each receptor transfected into the mammalian cells, for a total of 4 μg DNA (e.g., pCMV vector; pCMV vector with mutated THSR (TSHR-A6231); TSHR-A623I and GPR24, etc.) in 1.2 ml serum free DMEM (Irvine Scientific, Irvine, Calif.); tube B was prepared by mixing 120 μl lipofectamine (Gibco BRL) in 1.2 ml serum free DMEM. Tubes A and B were then admixed by inversion (several times), followed by incubation at room temperature for 30–45 min. The admixture is referred to as the "transfection mixture". Plated Hek-293 cells were washed with 1×PBS, followed by addition of 10 ml serum free DMEM. 2.4 ml of the transfection mixture was then added to the cells, followed by incubation for 4 hrs at 37° C./5% $CO_2$. The transfection mixture was then removed by aspiration, followed by the addition of 25 ml of DMEM/10% Fetal Bovine Serum. Cells were then incubated at 37° C./5% $CO_2$. After 24 hr incubation, cells were then harvested and utilized for analysis.

A FLASH PLATE™ Adenylyl Cyclase kit (New England Nuclear; Cat. No. SMP004A) designed for cell-based assays can be modified for use with crude plasma membranes. The Flash Plate wells can contain a scintillant coating which also contains a specific antibody recognizing cAMP. The cAMP generated in the wells can be quantitated by a direct competition for binding of radioactive cAMP tracer to the cAMP antibody. The following serves as a brief protocol for the measurement of changes in cAMP levels in whole cells that express the receptors.

Transfected cells were harvested approximately twenty four hours after transient transfection. Media was carefully aspirated and discarded. Ten milliliters of PBS was gently added to each dish of cells followed by careful aspiration. One milliliter of Sigma cell dissociation buffer and 3 ml of PBS are added to each plate. Cells were pipetted off the plate and the cell suspension is collected into a 50 ml conical centrifuge tube. Cells were then centrifuged at room temperature at 1,100 rpm for 5 min. The cell pellet was carefully re-suspended into an appropriate volume of PBS (about 3 ml/plate). The cells were then counted using a hemocytometer and additional PBS is added to give the appropriate number of cells (with a final concentration of about 50 μl/well).

cAMP standards and Detection Buffer (comprising 1 μCi of tracer [$^{125}$I cAMP (50 μl] to 11 ml Detection Buffer) was prepared and maintained in accordance with the manufacturer's instructions. Assay Buffer should be prepared fresh for screening and contained 50 μL of Stimulation Buffer, 3 μL of test compound (12 μM final assay concentration) and 50 μL cells, Assay Buffer can be stored on ice until utilized. The assay can be initiated by addition of 50 μL of cAMP standards to appropriate wells followed by addition of 50 μL of PBSA to wells H-11 and H12. Fifty μL of Stimulation Buffer was added to all wells. Selected compounds (e.g., TSH, 100 nM MCH, MCH/TSH) were added to appropriate wells using a pin tool capable of dispensing 3 μL of compound solution, with a final assay concentration of 12 μM test compound and 100 μL total assay volume. The cells were then added to the wells and incubated for 60 min at room temperature. 100 μL of Detection Mix containing tracer cAMP was then added to the wells. Plates were then incubated additional 2 hours followed by counting in a Wallac MicroBeta scintillation counter. Values of cAMP/well were then extrapolated from a standard cAMP curve which is contained within each assay plate.

FIG. 1 evidences about a 22% decrease in cAMP production of cells co-transfected with TSHR-A623I (in the presence of TSH) and non-endogenous, constitutively activated GPR24 ("24-IC3-SST2") (262.266 pmol cAMP/well) compared to TSHR-A623I with endogenous GPR24 ("GPR24 wt") (336.50293 pmol cAMP/well). Co-transfection of TSHR-A623I with non-endogenous, constitutively activated GPR24 ("I261Q") evidences about a 27% decrease in production of cAMP when compared to "GPR24 wt." Such a decrease in cAMP production signifies that non-endogenous version of GPR24 ("I261Q") is constitutively active. Thus, a candidate compound which impacts the GPR24 receptor by increasing the cAMP signal is an inverse agonist, while a GPR24 agonist will decrease the cAMP signal. Based upon the data generated for FIG. 1, 24-IC3-SST2 and I261Q are most preferred non-endogenous versions of GPR24 when used in a TSHR (constitutively activated co-transfection approach using a cAMP assay.

Figure 2:
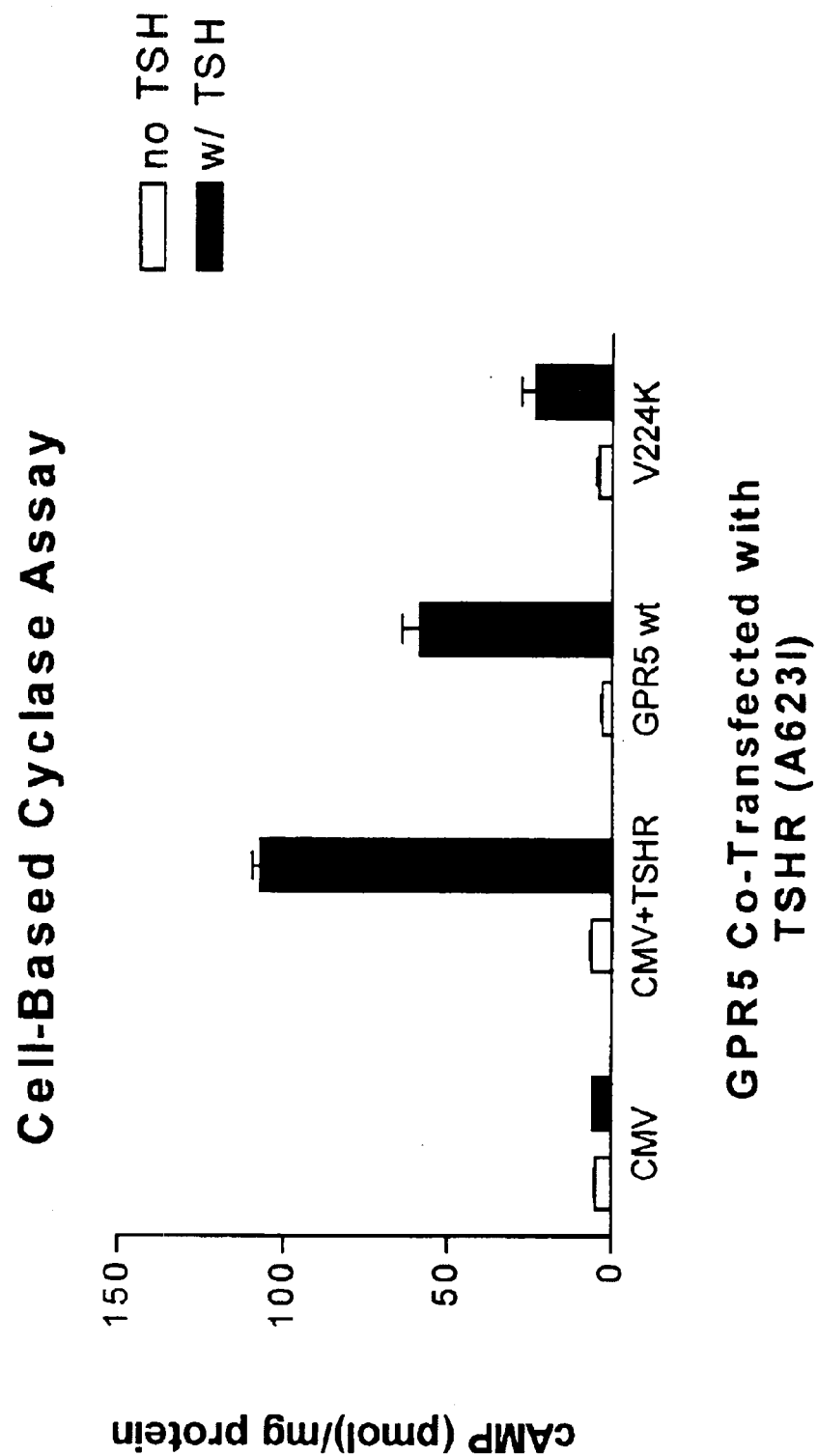
FIG. 2 provides graphic results of comparative analysis of a co-transfection of non-endogenous signal enhancer TSBR-A623I (with and without TSH) and endogenous target receptor GPR5 ("GPR5 wt"), versus non-endogenous, constitutively activated target receptor GPR5 ("V224K") co-transfected with non-endogenous TSHR-A623I (with and without TSH), utilizing an adenylyl cyclase assay.

FIG. 2 evidences about a 60% decrease in cAMP production of cells co-transfected with TSHR-A623I (in the presence of TSH) and non-endogenous, constitutively activated GPR5 ("V224K") (23.5 pmole cAMP/well) compared to TSHR-A623I with endogenous GPR5 ("GPR5 wt") (58.79 pmol cAMP/well). About a 78% and about a 45% decrease in production of cAMP was evidenced when comparing TSHR-A623I co-transfected with "V225K" and TSHR-A623I co-transfected with "GPR5 wt" against pCMV co-transfected with TSHR-A623I (106.75 pmol cAMP/well), respectively. As mentioned above, a decrease in cAMP production evidences a constitutively active GPR5. Thus, a preferred candidate compound (i.e., an inverse agonist) would likely bind the Gi coupled receptor to increase the signal of activation.

Preferably, and as noted previously, to ensure that a small molecule candidate compound is targeting the Gi coupled target receptor and not, for example, the TSHR-A623I, the directly identified candidate compound is preferably screened against the signal enhancer in the absence of the target receptor.

C. Reporter-Based Assays

1. CRE-Luc Reporter Assay (Gs-Associated Receptors)

A method to detect Gs stimulation depends on the known property of the transcription factor CREB, which is activated in a cAMP-dependent manner. A PATHDETECT™ CREB trans-Reporting System (Stratagene, Catalogue #219010) can utilized to assay for Gs coupled activity in 293 or 293T cells. Cells are transfected with the plasmids components of this above system and the indicated expression plasmid encoding endogenous or mutant receptor using a Mammalian Transfection Kit (Stratagene, Catalogue #200285) according to the manufacturer's instructions. Briefly, 400 ng pFR-Luc (luciferase reporter plasmid containing GaL4 recognition sequences), 40 ng pFA2-CREB (Ga14-CREB fusion protein containing the Ga14 DNA-binding domain), 80 ng pCMV-receptor expression plasmid (comprising the receptor) and 20 ng CMV-SEAP (secreted alkaline phosphatase expression plasmid; alkaline phosphatase activity is measured in the media of transfected cells to control for variations in transfection efficiency between samples) are combined in a calcium phosphate precipitate per the Kit's instructions. Half of the precipitate is equally distributed over 3 wells in a 96-well plate, kept on the cells overnight, and replaced with fresh medium the following morning. Forty-eight (48) hr after the start of the transfection, cells are treated and assayed for, e.g., luciferase activity.

2. 8XCRE-Luc Reporter Assay

HEK-293T cells are plated-out on 96 well plates at a density of $3 \times 10^4$ cells per well and were transfected using Lipofectamine Reagent (BRL) the following day according to manufacturer instructions. A DNA/lipid mixture is prepared for each 6-well transfection as follows: 260 ng of plasmid DNA in 100 $\mu$l of DMEM were gently mixed with 2 $\mu$l of lipid in 100 $\mu$l of DMEM (the 260 ng of plasmid DNA consisted of 200 ng of a 8xCRE-Luc reporter plasmid (see below and FIG. 1 for a representation of a portion of the plasmid), 50 ng of pCMV comprising endogenous receptor or non-endogenous receptor or pCMV alone, and long of a GPRS expression plasmid (GPRS in pcDNA3 (Invitrogen)). The 8XCRE-Luc reporter plasmid was prepared as follows: vector SRIF-β-gal was obtained by cloning the rat somatostatin promoter (−71/+51) at BglV-HindIII site in the pβgal-Basic Vector (Clontech). Eight (8) copies of cAMP response element were obtained by PCR from an adenovirus template AdpCF126CCRE8 (see, 7 *Human Gene Therapy* 1883 (1996)) and cloned into the SRIF-β-gal vector at the Kpn-BglV site, resulting in the 8xCRE-β-gal reporter vector. The 8xCRE-Luc reporter plasmid was generated by replacing the beta-galactosidase gene in the 8xCRE-p-gal reporter vector with the luciferase gene obtained from the pGL3-basic vector (Promega) at the HindIII-BamHI site. Following 30 min. incubation at room temperature, the DNA/lipid mixture was diluted with 400 $\mu$l of DMEM and 100 $\mu$l of the diluted mixture was added to each well. 100 $\mu$l of DMEM with 10% FCS were added to each well after a 4 hr incubation in a cell culture incubator. The following day the transfected cells were changed with 200 $\mu$l/well of DMEM with 10% FCS. Eight (8) hours later, the wells were changed to 100 $\mu$l/well of DMEM without phenol red, after one wash with PBS. Luciferase activity were measured the next day using the LucLite™ reporter gene assay kit (Packard) following manufacturer instructions and read on a 1450 Micro-Beta™ scintillation and luminescence counter (Wallac).

Figure 3A:
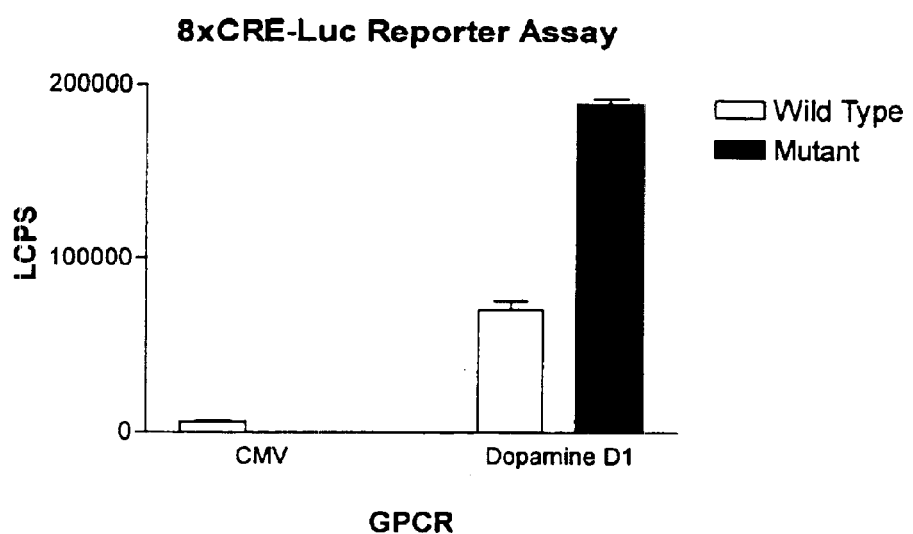
FIGS. 3A–3E provide a diagrammatic representation of the signal measured comparing CMV, non-endogenous, constitutively activated GPCRs, utilizing 8XCRE-Luc reporter plasmid.

FIG. 3A represents about a 63% increase in activity of the non-endogenous, constitutively active version of human Dopamine D1 receptor (189270 relative light units) compared with that of the endogenous Dopamine D1 (70622 relative light units).

Figure 3B:
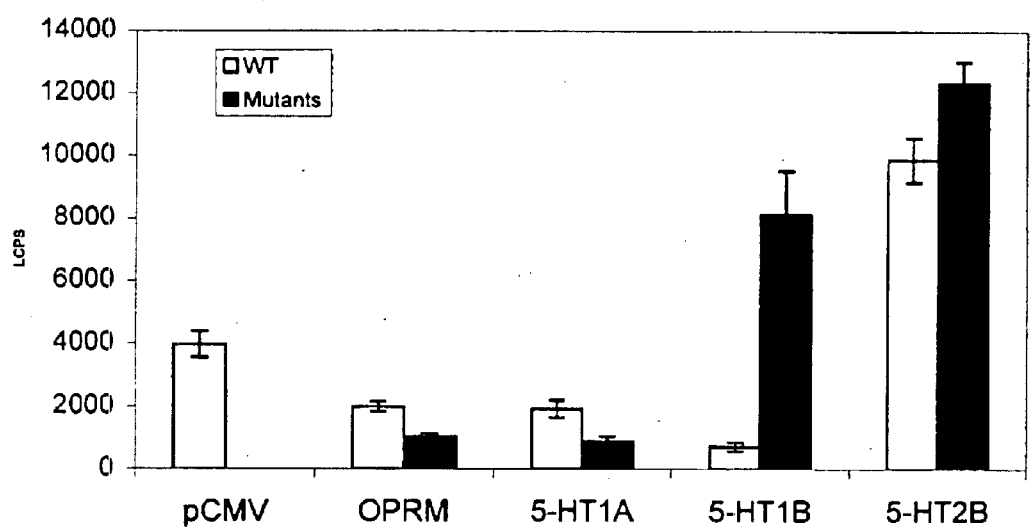

FIG. 3B represents about a 48% decreases in activity of the non-endogenous, constitutively active version of human OPRM (a Gi coupled receptor; see Example 4(3)), about a 53% decrease in activity of the non-endogenous, constitutively active version of human 5-HT1A (a Gi coupled receptor; see Example 4(3)), about a 91% increase in activity of the non-endogenous, constitutively active version of human 5-HT1B, and about a 20% increase in activity of the non-endogenous, constitutively active version of human 5-HT2B over the respective endogenous version of the GPCR.

Figure 3C:
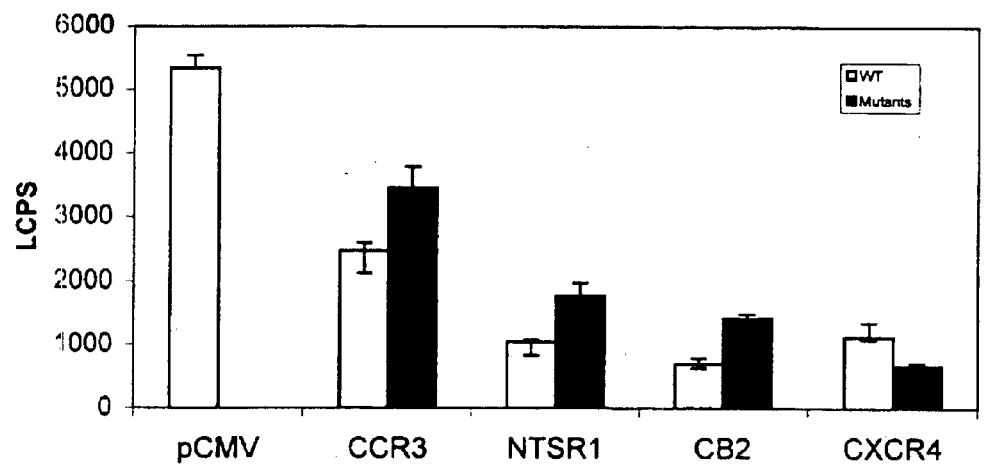

FIG. 3C represents about a 29% increase in activity of the non-endogenous, constitutively active version of human CCR3, about a 41% increase in activity of the non-endogenous, constitutively active version of human NTSR1, about a 51% increase in activity of the non-endogenous, constitutively active version of human CB2, and about a 40% decrease in activity of the non-endogenous, constitutively active version of human CXCR4 (a Gi coupled receptor; see Example 4(3)) over the respective endogenous version of the GPCR.

Figure 3D:
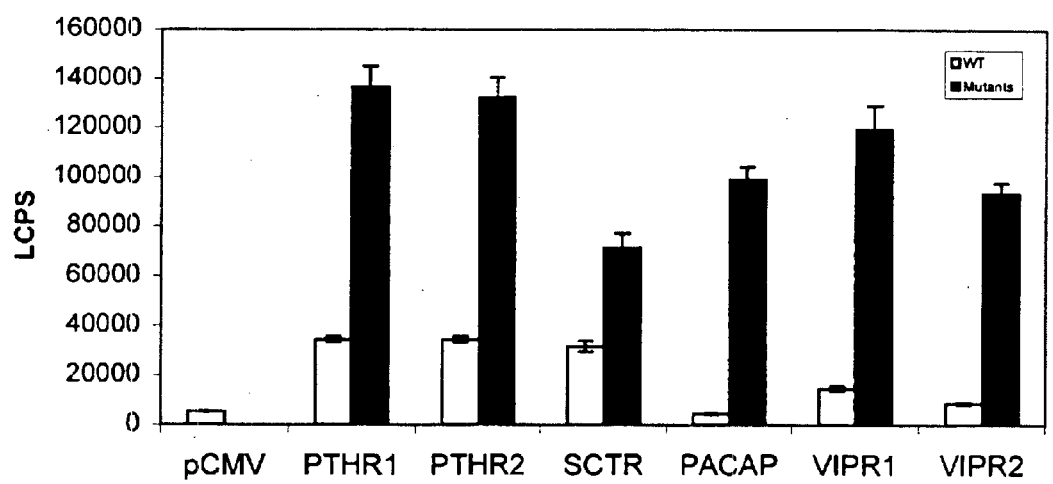

FIG. 3D represents about a 75% increase in activity of the non-endogenous, constitutively active version of human PTHR1, about a 74% increase in activity of the non-endogenous, constitutively active version of human PTHR2, about a 56% increase in activity of the non-endogenous, constitutively active version of human SCTR, about a 96% increase in activity of the non-endogenous, constitutively active version of human PACAP, about a 88% increase in activity of the non-endogenous, constitutively active version of human VIPR1, and about a 91% increase in activity of the non-endogenous, constitutively active version of human VIPR2 over the respective endogenous version of the GPCR.

Figure 3E:
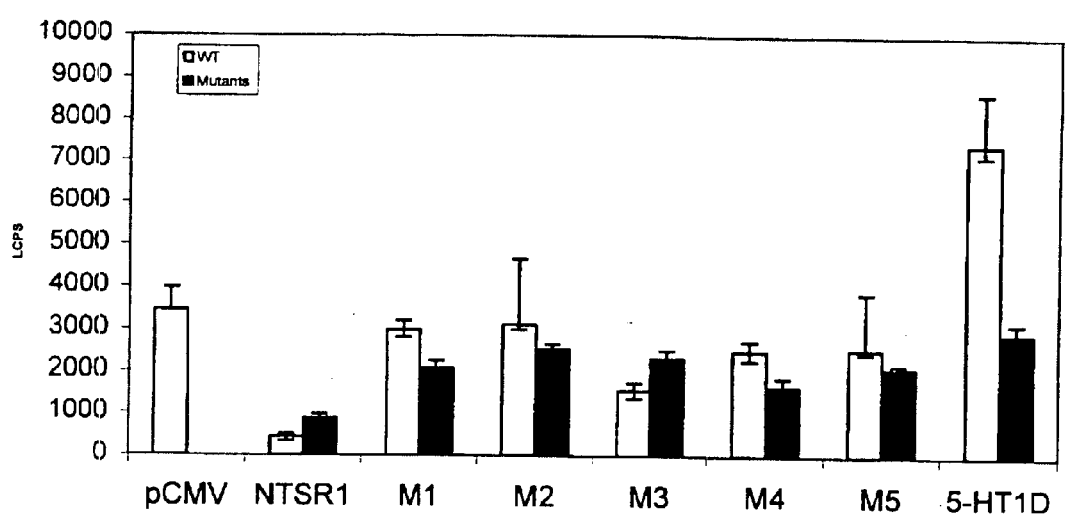

FIG. 3E represents about a 51% increase in activity of the non-endogenous, constitutively active version of human NTSR1, about a 31% decrease in activity of the non-endogenous, constitutively active version of human M1, about a 19% decrease in activity of the non-endogenous, constitutively active version of human M2, about a 32% increase in activity of the non-endogenous, constitutively active version of human M3, about a 33% decrease in activity of the non-endogenous, constitutively active version of human M4, about a 17% decrease in activity of the non-endogenous, constitutively active version of human M5, and about a 60% increase in activity of the non-endogenous, constitutively active version of human 5-HT1D over the respective endogenous version of the GPCR. M2, M4 and 5-HT1D are indicated as being Gi coupled while NTSR1, M1, M3 and M5 are indicated as being Gq coupled.

3. AP1 Reporter Assay (Gq-Associated Receptors)

A method to detect Gq stimulation depends on the known property of Gq-dependent phospholipase C to cause the activation of genes containing AP1 elements in their promoter. A PATHDETECT™ AP-1 cis-Reporting System (Stratagene, Catalog #219073) can be utilized following the protocol set forth above with respect to the CREB reporter assay, except that the components of the calcium phosphate precipitate were 410 ng pAP1-Luc, 80 ng pCMV-receptor expression plasmid, and 20 ng CMV-SEAP.

4. SRF-Luc Reporter Assay (Gq-Associated Receptors)

One method to detect Gq stimulation depends on the known property of Gq-dependent phospholipase C to cause the activation of genes containing serum response factors in their promoter. A PATHDETECT™ SRF-Luc-Reporting System (Stratagene) can be utilized to assay for Gq coupled activity in, e.g., COS7 cells. Cells are transfected with the plasmid components of the system and the indicated expression plasmid encoding endogenous or non-endogenous GPCR using a MAMMALIAN TRANSFECTION™ Kit (Stratagene, Catalogue #200285) according to the manufacturer's instructions. Briefly, 410 ng SRF-Luc, 80 ng pCMV-receptor expression plasmid and 20 ng CMV-SEAP (secreted alkaline phosphatase expression plasmid; alkaline phosphatase activity is measured in the media of transfected cells to control for variations in transfection efficiency between samples) are combined in a calcium phosphate precipitate as per the manufacturer's instructions. Half of the precipitate is equally distributed over 3 wells in a 96-well plate, kept on the cells in a serum free media for 24 hours. The last 5 hours the cells are incubated with 1 $\mu$M Angiotensin, where indicated. Cells are then lysed and assayed for luciferase activity using a LUCLITE™ Kit (Packard, Cat. #6016911) and "Trilux 1450 Microbeta" liquid scintillation and luminescence counter (Wallac) per the manufacturer's instructions. The data can be analyzed using GraphPad Prism™ 2.0a (GraphPad Software Inc.).

5. Intracellular $IP_3$ Accumulation Assay (Gq-Associated Receptors)

On day 1, cells comprising the receptors (endogenous and/or non-endogenous) can be plated onto 24 well plates, usually $1 \times 10^5$ cells/well (although this number can be optimized. On day 2 cells can be transfected by firstly mixing 0.25 $\mu$g DNA in 50 $\mu$L serum free DMEM/well and 2 $\mu$L lipofectamine in 50 $\mu$l serum-free DMEM/well. The solutions are gently mixed and incubated for 15–30 min at room temperature. Cells are washed with 0.5 ml PBS and 400 $\mu$l of serum free media is mixed with the transfection media and added to the cells. The cells are then incubated for 3–4 hrs at 37° C./5% $CO_2$ and then the transfection media is removed and replaced with 1 ml/well of regular growth media. On day 3 the cells are labeled with $^3$H-myo-inositol. Briefly, the media is removed and the cells are washed with 0.5 ml PBS. Then 0.5 ml inositol-free/serum free media (GIBCO BRL) is added/well with 0.25 $\mu$Ci of $^3$H-myo-inositol/well and the cells are incubated for 16–18 hrs o/n at 37° C./5% $CO_2$. On Day 4 the cells are washed with 0.5 ml PBS and 0.45 ml of assay medium is added containing inositol-free/serum free media 10 $\mu$M pargyline 10 mM lithium chloride or 0.4 ml of assay medium and 50 $\mu$L of 10× ketanserin (ket) to final concentration of 10 $\mu$M. The cells are then incubated for 30 min at 37° C. The cells are then washed with 0.5 ml PBS and 200 $\mu$L of fresh/ice cold stop solution (1M KOH; 18 mM Na-borate; 3.8 mM EDTA) is added/well. The solution is kept on ice for 5–10 min or until cells were lysed and then neutralized by 200 $\mu$l of fresh/ice cold neutralization sol. (7.5% HCL). The lysate is then transferred into 1.5 ml eppendorf tubes and 1 ml of chloroform/methanol (1:2) is added/tube. The solution is vortexed for 15 sec and the upper phase is applied to a Biorad AG1-X8™ anion exchange resin (100–200 mesh). Firstly, the resin is washed with water at 1:1.25 W/V and 0.9 ml of upper phase is loaded onto the column. The column is washed with 10 mls of 5 mM myo-inositol and 10 ml of 5 mM Na-borate/60 mM Na-formate. The inositol tris phosphates are eluted into scintillation vials containing 10 ml of scintillation cocktail with 2 ml of 0.1 M formic acid/1 M ammonium formate. The columns are regenerated by washing with 10 ml of 0.1 M formic acid/3M ammonium formate and rinsed twice with $H_2O$ and stored at 4° C. in water.

Figure 4:
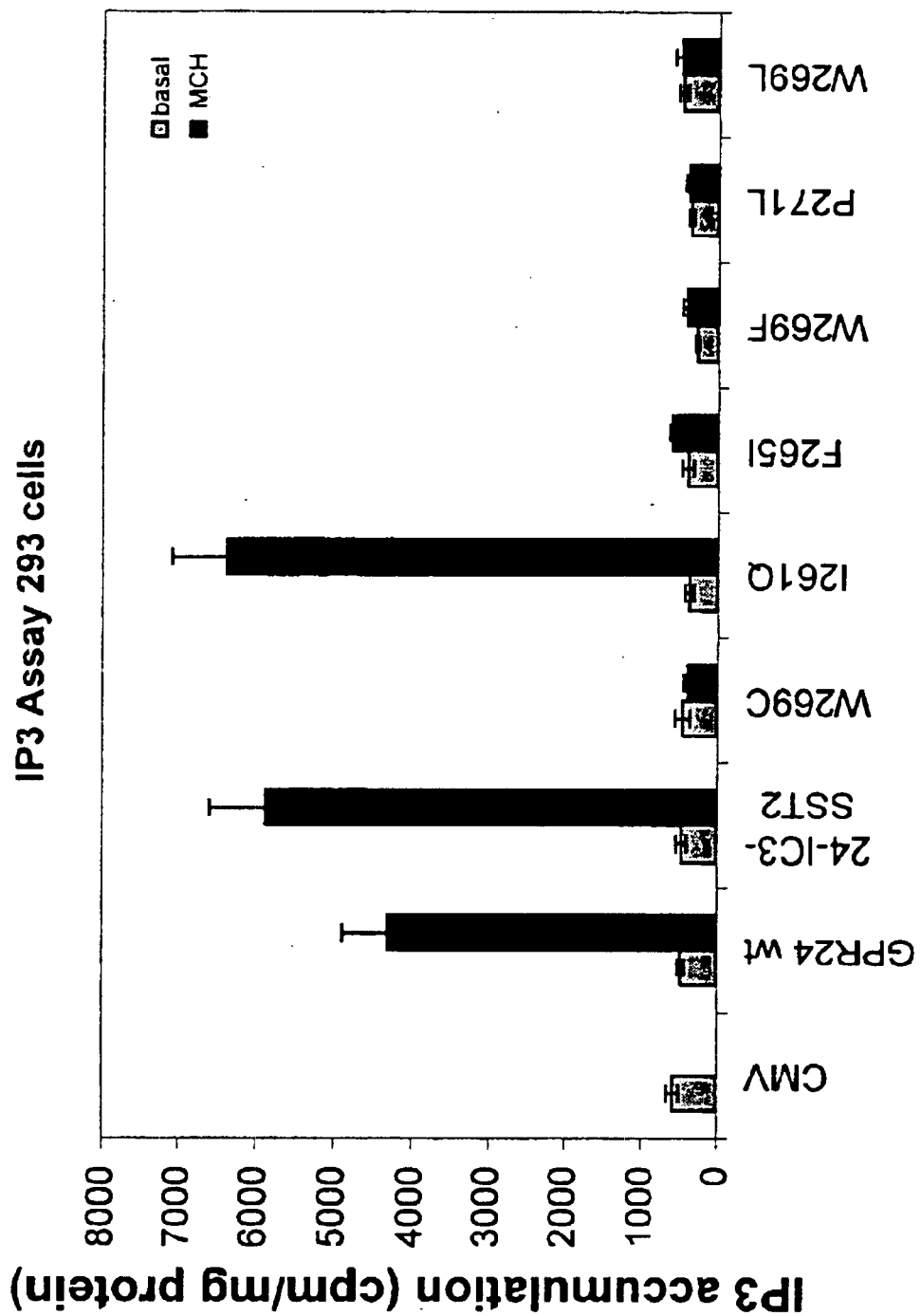
FIG. 4 provides an illustration of $IP_3$ production from several non-endogenous versions of GPR24 as compared with the endogenous version of this receptor.

FIG. 4 represents two preferred non-endogenous, constitutively activated exemplary versions of GPR24, 24-IC3-SST2 and I261Q, for use in an IP3 assay. When compared to the endogenous version of GPR24 ("GPR24 wt"), 24-IC3-SST2 evidenced about a 27% increase in $IP_3$ accumulation, while the I26Q version represented and about a 32% increase.

Example 6

GPCR Fusion Protein Preparation

The design of the constitutively activated GPCR-G protein fusion construct was accomplished as follows: both the 5' and 3' ends of the rat G protein Gsα (long form; Itoh, H. et al., 83 PNAS 3776 (1986)) were engineered to include a HindIII (5'-AAGCTT-3') sequence thereon. Following confirmation of the correct sequence (including the flanking HindIII sequences), the entire sequence was shuttled into pcDNA3.1(−) (Invitrogen, cat. no. V795-20) by subcloning using the HindIII restriction site of that vector. The correct orientation for the Gsα. sequence was determined after subcloning into pcDNA3.1(−). The modified pcDNA3.1(−) containing the rat Gsα gene at HindIII sequence was then verified; this vector was now available as a "universal" Gsα protein vector. The pcDNA3.1 (−) vector contains a variety of well-known restriction sites upstream of the HindIII site, thus beneficially providing the ability to insert, upstream of the Gs protein, the coding sequence of an endogenous, constitutively active GPCR. This same approach can be utilized to create other "universal" G protein vectors, and, of course, other commercially available or proprietary vectors known to the artisan can be utilized—the important criteria is that the sequence for the GPCR be upstream and in-frame with that of the G protein.

1. TSHR-Gsα Fusion Protein
   a. Stable Cell Line Production for TSHR

Approximately 1.2 to 1.3×10$^7$ HEK-293 cells are plated on a 15 cm tissue culture plate. Grown in DME High Glucose Medium containing ten percent fetal bovine serum and one percent sodium pyruvate, L-glutamine, and antibiotics. Twenty-four hours following plating of 293 cells to ~80% confluency, the cells are transfected using 12 μg of DNA. The 12 μg of DNA is combined with 60 μL of lipofectamine and 2 mL of DME High Glucose Medium without serum. The medium is aspirated from the plates and the cells are washed once with medium without serum. The DNA, lipofectamine, and medium mixture is added to the plate along with 10 mL of medium without serum. Following incubation at 37° C. for four to five hours, the medium is aspirated and 25 ml of medium containing serum is added. Twenty-four hours following transfection, the medium is aspirated again, and fresh medium with serum is added. Forty-eight hours following transfection, the medium is aspirated and medium with serum is added containing geneticin (G418 drug) at a final concentration of 500 μg/mL. The transfected cells now undergo selection for positively transfected cells containing the G418 resistant gene. The medium is replaced every four to five days as selection occurs. During selection, cells are grown to create stable pools, or split for stable clonal selection.

b. TSHR(A623K) Fusion Protein

TSHR-Gsα Fusion Protein construct was then made as follows: primers were designed for both endogenous, constitutively activated and non-endogenous, constitutively activated TSAR were as follows:

```
                                    (SEQ.ID.NO.:582; sense)
5'-gatc[TCTAGA]ATGAGGCCGGCGGACTTGCTGC-3'

(SEQ.ID.NO.:583; antisense)
5'-ctag[GATATC]CGCAAAACCGTTTGCATATACTC-3'.
```

Nucleotides in lower caps are included as spacers just before the restriction sites between the endogenous TSHR and G protein. The sense and anti-sense primers included the restriction sites for XbaI and EcorV, respectively.

PCR was then utilized to secure the respective receptor sequences for fusion within the Gsα universal vector disclosed above, using the following protocol for each: 100 ng cDNA for TSHR(A623K) was added to separate tubes containing 2 μL of each primer (sense and anti-sense), 3 μL of 10 mM dNTPs, 10 μL of 10×TaqPlus™ Precision buffer, 1 μL of TaqPlus™ Precision polymerase (Stratagene: #600211), and 80 μL of water. Reaction temperatures and cycle times for TSHR were as follows: the initial denaturing step was done at 94° C. for five minutes, and a cycle of 94° C. for 30 seconds; 55° C. for 30 seconds; 72° C. for two minutes. A final extension time was done at 72° C. for ten minutes. PCR product for was run on a 1% agarose gel and then purified (data not shown). The purified product was digested with XbaI and EcorV (New England Biolabs) and the desired inserts isolated, purified and ligated into the Gs universal vector at the respective restriction site. The positive clones were isolated following transformation and determined by restriction enzyme digest; expression using Hek-293 cells was accomplished following the protocol set forth infra. Each positive clone for TSHR: Gs-Fusion Protein was sequenced and made available for the direct identification of candidate compounds. (See, SEQ. ID. NO.:588 for nucleic acid sequence and SEQ. ID. NO.:589 for amino acid sequence).

Location of non-endogenous version of TSHR(A623K) is located upstream from the rat G protein Gsox (i.e., from nucleotide 1 through 2,292; see, SEQ. ID. NO.:586 and amino acid residue 1 through 764; see, SEQ. ID. NO.:587). TSHR(A623K) can be linked directly to the G protein, or there can be spacer residues between the two. With respect to TSHR, 24 amino acid residues (an equivalent of 72 nucleotides) were placed in between the non-endogenous GPCR and the start codon for the G protein Gsu. Therefore, the Gs protein is located at nucleotide 2,365 through 3,549 (see, SEQ. ID. NO.:586) and at amino acid residue 789 through 1,183 (see, SEQ. ID. NO.:587). Those skilled in the art are credited with the ability to select techniques for constructing a GPCR Fusion Protein where the G protein is fused to the 3' end of the GPCR of interest.

Figure 5:
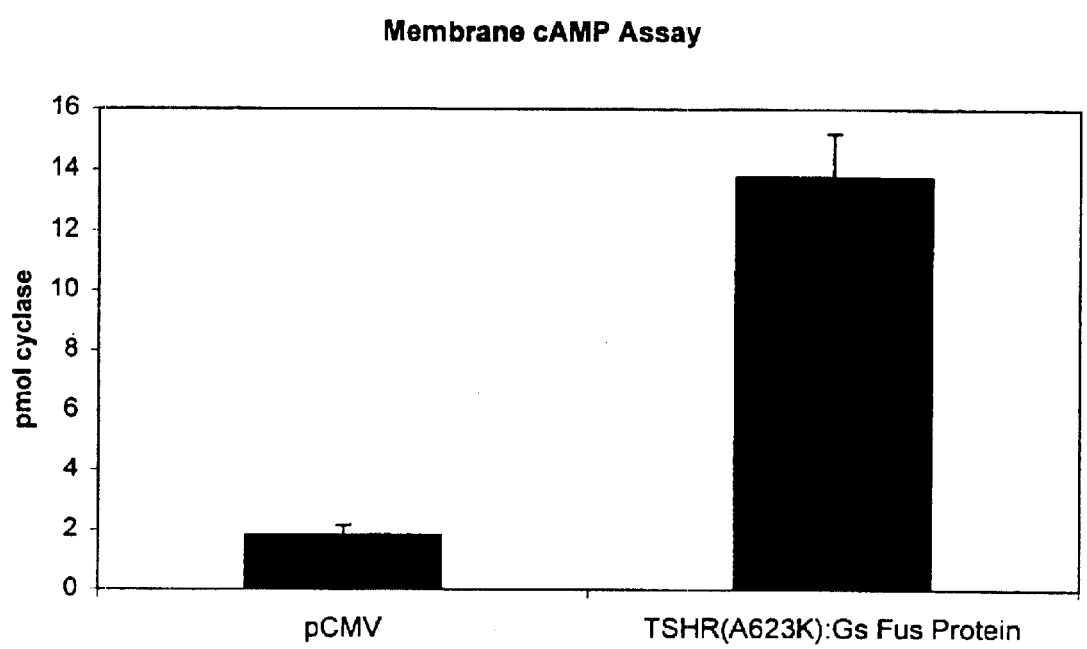
FIG. 5 is a graphic representation of the results of a membrane-based cyclic AMP assay providing comparative results for constitutive signaling of TSHR-A623K:Fusion Protein and a control vector (pCMV).

GPCR Fusion Protein was analyzed (to stabilize the GPCR while screening for candidate compounds, as shown in Example 6) and verified to be constitutively active utilizing the protocol found in Example 4(2). In FIG. 5, TSHR(A623K)-Gαs:Fusion Protein evidenced about an 87% increase in cAMP when compared to the control vector (pCMV).

2. GPR24-Giα Fusion Protein

GPR24-Giα Fusion Protein construct was then made as follows: primers were designed for both endogenous, constitutively activated and non-endogenous, constitutively activated GPR24 were as follows:

```
                                    (SEQ.ID.NO.:584; sense)
5'-GTGAAGCTTGCCCGGGCAGGATGGACCTGG-3'

(SEQ.ID.NO.:585; antisense)
5'-ATCTAGAGGTGCCTTTGCTTTCTG-3'.
```

The sense and anti-sense primers included the restriction sites for KB4 and XbaI, respectively.

PCR was then utilized to secure the respective receptor sequences for fusion within the Gict universal vector disclosed above, using the following protocol for each: 100 ng cDNA for GPR24 was added to separate tubes containing 2 μL of each primer (sense and anti-sense), 3 μL of 10 mM dNTPs, 10 μL of 10×TaqPlus™ Precision buffer, 1 μL of TaqPlus™ Precision polymerase (Stratagene: #600211), and 80 μL of water. Reaction temperatures and cycle times for GPR24 were as follows: the initial denaturing step was done it 94° C. for five minutes, and a cycle of 94° C. for 30 seconds; 55° C. for 30 seconds; 72° C. for two minutes. A final extension time was done at 72° C. for ten minutes. PCR product for was run on a 1% agarose gel and then purified (data not shown). The purified product was digested with KB4 and XbaI (New England Biolabs) and the desired inserts will be isolated, purified and ligated into the Gi universal vector at the respective restriction site. The positive clones was isolated following transformation and determined by restriction enzyme digest; expression using Hek-293 cells was accomplished following the protocol set forth infra. Each positive clone for GPR24: Gi-Fusion Protein was sequenced and made available for the direct identification of candidate compounds. (See, SEQ. ID. NO.:590 for nucleic acid sequence and SEQ. ID. NO.:591 for amino acid sequence).

Endogenous version of GPR24 was fused upstream from the G protein Gi and is located at nucleotide 1 through 1,059 (see, SEE. ID. NO.:588) and amino acid residue 1 through 353 (see, SEQ. ID. NO.:589). With respect to GPR24, 2 amino acid residues (an equivalent of 6 nucleotides) were placed in between the endogenous (or non-endogenous) GPCR and the start codon for the G protein Giα. Therefore, the Gi protein is located at nucleotide 1,066 through 2,133 (see, SEQ. ID. NO.:588) and at amino acid residue 356 through 711 (see, SEQ. ID. NO.:589). Those skilled in the art are credited with the ability to select techniques for constructing a GPCR Fusion Protein where the G protein is fused to the 3' end of the GPCR of interest.

Although it is indicated above that Gi coupled receptors, such as GPR24, can be used in conjunction with a co-transfection approach, this is in the context of cAMP based assays and is predicated upon the effect of Gi on cAMP levels. However, for other types of assays, such as a GTP based assay, the co-transfection approach is not essential. Thus for assays such as a GTP based assay, the GPCR Fusion Protein approach is preferred such that, with respect to a GTP based assay for GPR24, the GPR24:Gi Fusion Protein would be preferred.

Example 6
Protocol: Direct Identification of Inverse Agonists and Agonists Using [$^{35}$S]GTPγS Although Endogenous GPCRs may be utilized for the direct identification of candidate compounds as, e.g., inverse agonists, for reasons that are not altogether understood, intra-assay variation can become exacerbated. Preferably, then, a GPCR Fusion Protein, as disclosed above, can also be utilized with a non-endogenous, constitutively activated GPCR. We can determine that when such a protein is used, intra-assay variation appears to be substantially stabilized, whereby an effective signal-to-noise ratio is obtained. This has the beneficial result of allowing for a more robust identification of candidate compounds. Thus, it is preferred that for direct identification, a GPCR Fusion Protein be used and that when utilized, the following assay protocols be utilized.

1. Membrane Preparation

Membranes comprising the non-endogenous, constitutively active GPCR Fusion Protein of interest and for use in the direct identification of candidate compounds as inverse agonists, agonists or partial agonists are preferably prepared as follows:

a. Materials

"Membrane Scrape Buffer" is comprised of 20 mM HEPES and 10 mM EDTA, pH 7.4; "Membrane Wash Buffer" is comprised of 20 mM HEPES and 0.1 mM EDTA, pH 7.4; "Binding Buffer" is comprised of 20 mM HEPES, 100 mM NaCl, and 10 mM MgCl$_2$, pH 7.4.

b. Procedure

All materials will be kept on ice throughout the procedure. First, the media is aspirated from a confluent monolayer of cells, followed by rinse with 10 ml cold PBS, followed by a aspiration. Thereafter, 5 ml of Membrane Scrape Buffer will be added to scrape cells; this is followed by transfer of cellular extract into 50 ml centrifuge tubes (centrifuged at 20,000 rpm for 17 minutes at 4° C.). Thereafter, the supernatant is aspirated and the pellet is resuspended in 30 ml Membrane Wash Buffer followed by centrifugation at 20,000 rpm for 17 minutes at 4° C. The supernatant will then be aspirated and the pellet resuspended in Binding Buffer. This is then homogenized using a Brinkman Polytron™ homogenizer (15–20 second bursts until the all material is in suspension). This is referred to herein as "Membrane Protein".

2. Bradford Protein Assay

Following the homogenization, protein concentration of the membranes will be determined using the Bradford Protein Assay (protein can be diluted to about 1.5 mg/ml, aliquoted and frozen (−80° C.) for later use; when frozen, protocol for use is as follows: on the day of the assay, frozen Membrane Protein is thawed at room temperature, followed by vortex and then homogenized with a Polytron at about 12×1,000 rpm for about 5–10 seconds; it is noted that for multiple preparations, the homogenizer should be thoroughly cleaned between homogenization of different preparations).

a. Materials

Binding Buffer (as per above); Bradford Dye Reagent; Bradford Protein Standard are utilized, following manufacturer instructions (Biorad, cat. no. 500-0006).

b. Procedure

Duplicate tubes will be prepared, one including the membrane, and one as a control "blank". Each contained 800 μL Binding Buffer. Thereafter, 10 μL of Bradford Protein Standard (1 mg/ml) is added to each tube, and 10 μL of membrane Protein is then added to just one tube (not the blank). Thereafter, 200 μL of Bradford Dye Reagent is added to each tube, followed by vortex of each. After five (5) minutes, the tubes will be re-vortexed and the material therein is transferred to cuvettes. The cuvettes are then read using a CECIL 3041 spectrophotometer, at wavelength 595.

3. Direct Identification Assay a. Materials

GDP Buffer consists of 37.5 ml Binding Buffer and 2 mg GDP (Sigma, cat. no. G-7127), followed by a series of dilutions in Binding Buffer to obtain 0.2 μM GDP (final concentration of GDP in each well was 0.1 μM GDP); each well comprising a candidate compound, will have a final volume of 200 μL consisting of 100 μL GDP Buffer (final concentration, 0.1 μM GDP), 50 μL Membrane Protein in Binding Buffer, and 50 μL [$^{35}$S]GTPγS (0.6 nM) in Binding Buffer (2.5 μL [$^{35}$S]GTPγS per 10 ml Binding Buffer).

b. Procedure

Candidate compounds are preferably screened using a 96-well plate format (these can be frozen at −80° C.). Membrane Protein (or membranes with expression vector excluding the GPCR Fusion Protein, as control) will be homogenized briefly until in suspension. Protein concentration is then determined using the Bradford Protein Assay set forth above. Membrane Protein (and control) is then diluted to 0.25 mg/ml in Binding Buffer (final assay concentration, 12.5 μg/well). Thereafter, 100 μL GDP Buffer will be added to each well of a Wallac Scintistrip™ (Wallac). A 5 μL pin-tool is then used to transfer 5 μL of a candidate compound into such well (i.e., 5 μL in total assay volume of 200 μL is a 1:40 ratio such that the final screening concentration of the candidate compound is 10 μM). Again, to avoid contamination, after each transfer step the pin tool should be rinsed in three reservoirs comprising water (1×), ethanol (1×) and water (2×)—excess liquid should be shaken from the tool after each rinse and dried with paper and kimwipes. Thereafter, 50 μL of Membrane Protein is added to each well (a control well comprising membranes without the GPCR Fusion Protein is also utilized), and pre-incubated for 5–10 minutes at room temperature. Thereafter, 50 μL of [$^{35}$S] GTPγS (0.6 nM) in Binding Buffer will be added to each well, followed by incubation on a shaker for 60 minutes at room temperature (again, in this example, plates were covered with foil). The assay is then stopped by spinning of the plates at 4000 RPM for 15 minutes at 22° C. The plates will then be aspirated with an 8 channel manifold and sealed with plate covers. The plates are then read on a Wallacc 1450 using setting "Prot. #37" (per manufacturer instructions).

Example 7

Protocol: Confirmation Assay

Using an independent assay approach to provide confirmation of a directly identified candidate compound as set forth above, it is preferred that a confirmation assay then be utilized. In this case, the preferred confirmation assay is a cyclase-based assay.

A modified FLASH PLATE™ Adenylyl Cyclase kit (New England Nuclear; Cat. No. SMP004A) is preferably utilized for confirmation of candidate compounds directly identified as inverse agonists and agonists to non-endogenous, constitutively activated GPCR in accordance with the following protocol.

Transfected cells will be harvested approximately three days after transfection. Membranes are prepared by homogenization of suspended cells in buffer containing 20 mM HEPES, pH 7.4 and 10 mM MgCl$_2$. Homogenization is performed on ice using a Brinkman POLYTRON™ for approximately 10 seconds. The resulting homogenate will be centrifuged at 49,000×g for 15 minutes at 4° C. The resulting pellet is then resuspended in buffer containing 20 mM IEPES, pH 7.4 and 0.1 mM EDTA, homogenized for 10 seconds, followed by centrifugation at 49,000×g for 15 minutes at 4° C. The resulting pellet can be stored at −80° C. until utilized. On the day of direct identification screening, the membrane pellet is slowly thawed at room temperature, resuspended in buffer containing 20 mM HEPES, pH 7.4 and 10 mM MgCl$_2$, to yield a final protein concentration of 0.60 mg/ml (the resuspended membranes are placed on ice until use).

cAMP standards and Detection Buffer (comprising 2 μCi of tracer [$^{125}$I cAMP (100 μl)] to 11 ml Detection Buffer) will be prepared and maintained in accordance with the manufacturer's instructions. Assay Buffer will be prepared fresh for screening and contained 20 mM HEPES, pH 7.4, 10 mM MgCl$_2$, 20 mM phospocreatine (Sigma), 0.1 units/ml creatine phosphokinase (Sigma), 50 μM GTP (Sigma), and 0.2 mM ATP (Sigma); Assay Buffer can be stored on ice until utilized.

Candidate compounds identified as per above (if frozen, thawed at room temperature) will then be added, preferably, to 96-well plate wells (3 μl/well; 12 μM final assay concentration), together with 40 μl Membrane Protein (30 μg/well) and 50 μl of Assay Buffer. This mixture is then incubated for 30 minutes at room temperature, with gentle shaking.

Following the incubation, 100 μl of Detection Buffer is added to each well, followed by incubation for 2–24 hours. Plates are then counted in a Wallac MICROBETA™ plate reader using "Prot. #31" (as per manufacturer instructions).

Example 8

Ligand-Based Confirmation Assay

Membranes will be prepared from transfected Hek-293 cells (see Example 3) by homogenization in 20 mM HEPES and 10 mM EDTA, pH 7.4 and centrifuged at 49,000×g for 15 min. The pellet will be resuspended in 20 mM HEPES and 0.1 mM EDTA, pH 7.4, homogenized for 10 sec using Polytron homogenizer (Brinkman) at 5000 rpm and centrifuged at 49,000×g for 15 min. The final pellet will be resuspended in 20 mM HEPES and 10 mM MgCl$_2$, pH 7.4, homogenized for 10 sec using Polytron homogenizer (Brinkman) at 5000 rpm.

Ligand-based confirmation assays will be performed in triplicate 200 μl volumes in 96 well plates. Assay buffer (20 mM HEPES and 10 mM MgCl$_2$, pH 7.4) will be used to dilute membranes, tritiated inverse agonists and/or agonists and the receptor's endogenous ligand (used to define non-specific binding). Final assay concentrations will consist of 1 nM of tritiated inverse agonist and/or agonist, 50 μg membrane protein (comprising the receptor) and 100 μm of endogenous ligand. Agonist assay will be incubated for 1 hr at 37° C., while inverse agonist assays are incubated for 1 hr at room temperature. Assays will terminate by rapid filtration onto Wallac Filtermat Type B with ice cold binding buffer using Skatron cell harvester. The radioactivity will be determined in a Wallac 1205 BetaPlate counter.

Again, this approach is used merely to understand the impact of the directly identified candidate compound on ligand binding. As those in the art will appreciate, it is possible that the directly identified candidate compounds may be allosteric modulators, (i.e., compounds that affect the functional activity of the receptor but which do not inhibit the endogenous ligand from binding to the receptor. Allosteric modulators include inverse agonists, partial agonists and agonists.

References cited throughout this patent document, including co-pending and related patent applications, unless otherwise indicated, are fully incorporated herein by reference. Modifications and extension of the disclosed inventions that are within the purview of the skilled artisan are encompassed within the above disclosure and the claims that follow.

Although a variety of expression vectors are available to those in the art, for purposes of utilization for both the endogenous and non-endogenous known GPCRs, it is most preferred that the vector utilized be pCMV. This vector was deposited with the American Type Culture Collection (ATCC) on Oct. 13, 1998 (10801 University Blvd., Manassas, Va. 20110-2209 USA) under the provisions of the Budapest Treaty for the International Recognition of the Deposit of Microorganisms for the Purpose of Patent Procedure. The DNA was tested by the ATCC and determined to be. The ATCC has assigned the following deposit number to pCMV: ATCC #203351.

SEQUENCE LISTING (589 sequences)

SEQ ID NO: 1 - DNA, 36 bp, Homo sapiens
cggaagcttagccatggatgtgctcagccctggtca

SEQ ID NO: 2 - DNA, 34 bp, Homo sapiens
ccggaattcctggcggcagaagttacacttaatg

SEQ ID NO: 3 - DNA, 32 bp, Homo sapiens
tccaagcttggggcgaggagagccatggagga

SEQ ID NO: 4 - DNA, 35 bp, Homo sapiens
ggcgaattcacttgtgcacttaaaacgtatcagtt

SEQ ID NO: 5 - DNA, 30 bp, Homo sapiens
atctaccatgtccccactgaaccagtcagc

SEQ ID NO: 6 - DNA, 32 bp, Homo sapiens
atagaattcggaggccttccggaaagggacaa

SEQ ID NO: 7 - DNA, 34 bp, Homo sapiens
ccacagtgtcgactgaaacaagggaaacatgaac

SEQ ID NO: 8 - DNA, 25 bp, Homo sapiens
cagtatgctctcggcatctaatgag

SEQ ID NO: 9 - DNA, 31 bp, Homo sapiens
atcaccatggatttcttaaattcatctgatc

SEQ ID NO: 10 - DNA, 33 bp, Homo sapiens
ttaggatccacatcgacatcgcacaagcttttg

SEQ ID NO: 11 - DNA, 37 bp, Homo sapiens
gaaaagcttgccatggctctctcttacagagtgtctg

SEQ ID NO: 12 - DNA, 35 bp, Homo sapiens
gttggatcctacataactaacttgctcttcagttt

SEQ ID NO: 13 - DNA, 32 bp, Homo sapiens
atcaccatggacaaacttgatgctaatgtgag

SEQ ID NO: 14 - DNA, 33 bp, Homo sapiens
cctgaattcgaagcatgattccagggattctgg

SEQ ID NO: 15 - DNA, 32 bp, Homo sapiens; identical to SEQ ID NO: 13

SEQ ID NO: 16 - DNA, 33 bp, Homo sapiens
agggaattcagtgtcactgggctgagcagccac

SEQ ID NO: 17 - DNA, 32 bp, Homo sapiens; identical to SEQ ID NO: 13

SEQ ID NO: 18 - DNA, 34 bp, Homo sapiens
ttggaattcggatggtttggtcaatcttctcttc

SEQ ID NO: 19 - DNA, 32 bp, Homo sapiens; identical to SEQ ID NO: 13

SEQ ID NO: 20 - DNA, 39 bp, Homo sapiens
agggaattcaaatcttagtacatgtgtggatccattaat

SEQ ID NO: 21 - DNA, 32 bp, Homo sapiens; identical to SEQ ID NO: 13

SEQ ID NO: 22 - DNA, 33 bp, Homo sapiens
tcagaattcgacaggaactggtctattgcagaa

SEQ ID NO: 23 - DNA, 39 bp, Homo sapiens
cctaagcttgccatggatttaccagtgaacctaacctcc

SEQ ID NO: 24 - DNA, 35 bp, Homo sapiens
tctgaattcgtgttgcctagaaaagaagttcttga

SEQ ID NO: 25 - DNA, 31 bp, Homo sapiens
agcggaattcggcggcgcgatgatggacgtt

SEQ ID NO: 26 - DNA, 30 bp, Homo sapiens
tttcggatccattgttctgctttcaatcat

SEQ ID NO: 27 - DNA, 31 bp, Homo sapiens
caggaattcagaacacctgccccagccccac

SEQ ID NO: 28 - DNA, 33 bp, Homo sapiens
agcggatcccgatgaagtgtccttggccaggga

SEQ ID NO: 29 - DNA, 30 bp, Homo sapiens
acagaattcagaagaaatggctcaaaggca

SEQ ID NO: 30 - DNA, 30 bp, Homo sapiens
catggatccttgaaaagctagaaactgtcc

SEQ ID NO: 31 - DNA, 33 bp, Homo sapiens
tgtaagcttcaggtcactgtgcatggcatcatc

SEQ ID NO: 32 - DNA, 36 bp, Homo sapiens
gctggatccattccgccagaaaagttggaagatttc

SEQ ID NO: 33 - DNA, 34 bp, Homo sapiens
actaagcttccaaatgttctctccctggaagata

SEQ ID NO: 34 - DNA, 33 bp, Homo sapiens
gttgaattcctgtctgctccctgcccagtcctg

SEQ ID NO: 35 - DNA, 32 bp, Homo sapiens
cagaagcttagcaatggcgtctttctctgctg

SEQ ID NO: 36 - DNA, 37 bp, Homo sapiens
acaggatcccacagttgtactatttctttctgaaatg

SEQ ID NO: 37 - DNA, 34 bp, Homo sapiens
gggaagcttaggagaccagaacatgaactccttc

SEQ ID NO: 38 - DNA, 33 bp, Homo sapiens
tgtgaattccactgcctgggtcttctgggccat

SEQ ID NO: 39 - DNA, 32 bp, Homo sapiens
gggaagctttctcagtcattttgagctcagcc

SEQ ID NO: 40 - DNA, 33 bp, Homo sapiens
tcagaattccagagcctcggcagacgtgtctgt

SEQ ID NO: 41 - DNA, 33 bp, Homo sapiens
caaaagcttctagacaagctcagtggaatctga

SEQ ID NO: 42 - DNA, 34 bp, Homo sapiens
gccgaattcgcaatcagagaggtctagatctctg

SEQ ID NO: 43 - DNA, 31 bp, Homo sapiens
gacaagcttccccagtacatccacaacatgc

SEQ ID NO: 44 - DNA, 33 bp, Homo sapiens
ctcggatcctaaaccagccgagacttcctgctc

SEQ ID NO: 45 - DNA, 33 bp, Homo sapiens
atcgccatgacaacctcactagatacagttgag

SEQ ID NO: 46 - DNA, 33 bp, Homo sapiens
tctgaattcaaacacaatagagagttccggctc

SEQ ID NO: 47 - DNA, 34 bp, Homo sapiens
gcaaagcttggaacaagatggattatcaagtgtc

SEQ ID NO: 48 - DNA, 33 bp, Homo sapiens
tccggatcccaagcccacagatatttcctgctc

SEQ ID NO: 49 - DNA, 32 bp, Homo sapiens
tgaaagcttcccgctgccttgatggattatac

SEQ ID NO: 50 - DNA, 34 bp, Homo sapiens
tgagaattccaaaatgtagtctacgctggaggaa

SEQ ID NO: 51 - DNA, 59 bp, Homo sapiens
atcaccatgacacccacagacttcacaagccctattcctaacatggctgatgactatgg

SEQ ID NO: 52 - DNA, 33 bp, Homo sapiens
gacgaattcgagggagagtgctcctgaggttgt

SEQ ID NO: 53 - DNA, 30 bp, Homo sapiens
atcaccatgggagggcacccgcagctccgt

SEQ ID NO: 54 - DNA, 33 bp, Homo sapiens
cgggaattcgactgctgtggactgcttgatgct

SEQ ID NO: 55 - DNA, 54 bp, Homo sapiens
atcaccatggaggggatcagtatatacacttcagataactacaccgaggaaatg

SEQ ID NO: 56 - DNA, 35 bp, Homo sapiens
tctgaattcgctggagtgaaaacttgaagactcag

SEQ ID NO: 57 - DNA, 30 bp, Homo sapiens
aagaagcttggcatcacgcacctcctctgg

SEQ ID NO: 58 - DNA, 28 bp, Homo sapiens
ggctctagaaatgggtacaaagagtgtt

SEQ ID NO: 59 - DNA, 29 bp, Homo sapiens
cggaagcttctggagcaggtagcagcatg

SEQ ID NO: 60 - DNA, 36 bp, Homo sapiens
cttggatccagatgagctgtatttattactggaacg

SEQ ID NO: 61 - DNA, 30 bp, Homo sapiens
atcaccatggagacaaattcctctctcccc

SEQ ID NO: 62 - DNA, 33 bp, Homo sapiens
cccgaattcctttgcctgtaactccacctctgc

SEQ ID NO: 63 - DNA, 33 bp, Homo sapiens
gcaaagcttgctgctggcaagatggaaaccaac

SEQ ID NO: 64 - DNA, 33 bp, Homo sapiens
ccagaattccattgcctgtaactcagtctctgc

SEQ ID NO: 65 - DNA, 30 bp, Homo sapiens
ccggaattcgccgggacagccccgcgggcc

SEQ ID NO: 66 - DNA, 33 bp, Homo sapiens
gcaggatccttatcacacatgagtacaattggt

SEQ ID NO: 67 - DNA, 31 bp, Homo sapiens
ggcgaattcggggtcagcggcaccatgaacg

SEQ ID NO: 68 - DNA, 29 bp, Homo sapiens
gtgggatcccagcgcgcccgctaagtgct

SEQ ID NO: 69 - DNA, 30 bp, Homo sapiens
cagaagcttcgccgccctcacgatgactac

SEQ ID NO: 70 - DNA, 33 bp, Homo sapiens
cgcgaattcgcagtaactttccaactcccggct

SEQ ID NO: 71 - DNA, 30 bp, Homo sapiens
tatgaattcagatgctctaaacgtccctgc

SEQ ID NO: 72 - DNA, 30 bp, Homo sapiens
tccggatccacctgcacctgcgcctgcacc

SEQ ID NO: 73 - DNA, 30 bp, Homo sapiens
aggaagcttttaggtgggaaaaaaaatcta

SEQ ID NO: 74 - DNA, 31 bp, Homo sapiens
ccggaattcaaggggcaaaatcaagggtcaa

SEQ ID NO: 75 - DNA, 32 bp, Homo sapiens
gccaaggttagccaccatgaacacttcagccc

SEQ ID NO: 76 - DNA, 33 bp, Homo sapiens
ggagaattcgcattggcgggagggagtgcggtg

SEQ ID NO: 77 - DNA, 33 bp, Homo sapiens
atcaccatgaataactcaacaaactcctctaac

SEQ ID NO: 78 - DNA, 33 bp, Homo sapien
gatgaattcccttgtagcgcctatgttcttata

SEQ ID NO: 79 - DNA, 32 bp, Homo sapiens
atcaccatgaccttgcacaataacagtacaac

SEQ ID NO: 80 - DNA, 33 bp, Homo sapiens
ctcgaaattccaaggcctgctcgggtgcgcgct

SEQ ID NO: 81 - DNA, 29 bp, Homo sapiens
atcaccatggccaacttcacacctgtcaa

SEQ ID NO: 82 - DNA, 33 bp, Homo sapiens
gccgaattccctggcagtgccgatgttccgata

SEQ ID NO: 83 - DNA, 30 bp, Homo sapiens
atcaccatggaaggggattcttaccacaat

SEQ ID NO: 84 - DNA, 33 bp, Homo sapiens
gacggatccgggtagcttgctgttcccctgcca

SEQ ID NO: 85 - DNA, 30 bp, Homo sapiens
caggaattctgacagcaatgaatgcttcgt

SEQ ID NO: 86 - DNA, 33 bp, Homo sapiens
aatggatcctatcccaagttcatgccgttgcag

SEQ ID NO: 87 - DNA, 31 bp, Homo sapiens
agtaagctttacgcctagcttcgaaatggat

SEQ ID NO: 88 - DNA, 33 bp, Homo sapiens
tgtgaattcggagagcacattggaggagaagct

SEQ ID NO: 89 - DNA, 35 bp, Homo sapiens
tccaagcttagaagcagccatggggacctgtgaca

SEQ ID NO: 90 - DNA, 35 bp, Homo sapiens
aacgaattcaatttcaacatgagttttggtggggg

SEQ ID NO: 91 - DNA, 27 bp, Homo sapiens
atctgcagaccggtggcgatggccact

SEQ ID NO: 92 - DNA, 35 bp, Homo sapiens
atgggatccagaatattcatccacagaggtatagg

SEQ ID NO: 93 - DNA, 31 bp, Homo sapiens
tgagaattccagcggactctgctggaaagga

SEQ ID NO: 94 - DNA, 30 bp, Homo sapiens
gttggatccaggtagtgagttgaatggcca

SEQ ID NO: 95 - DNA, 31 bp, Homo sapiens
ggaaagcttcaagaaagactataatatggat

SEQ ID NO: 96 - DNA, 32 bp, Homo sapiens
ggaggatccagtgagaattattacatatgaag

SEQ ID NO: 97 - DNA, 33 bp, Homo sapiens
cggaagcttgcagccatggaaccggccccctcc

SEQ ID NO: 98 - DNA, 33 bp, Homo sapiens
gccgaattcggcggcagcgccaccgccgggacc

SEQ ID NO: 99 - DNA, 31 bp, Homo sapiens
agtaagcttgcagggcagtggcatggagccc

SEQ ID NO: 100 - DNA, 33 bp, Homo sapiens
gccgaattctgcgggccgcggtaccgtctcaga

SEQ ID NO: 101 - DNA, 35 bp, Homo sapiens
tttaagcttgcagcactcaccatggaatccccgat

SEQ ID NO: 102 - DNA, 28 bp, Homo sapiens
ctactggtttattcatcccatcgatgtc

SEQ ID NO: 103 - DNA, 30 bp, Homo sapiens
accaagcttgagcccgtgatgtccggcacc

SEQ ID NO: 104 - DNA, 29 bp, Homo sapiens
cagggatccttgtcatatgaataaatatt

SEQ ID NO: 105 - DNA, 33 bp, Homo sapiens
agtaagcttggccaagaagtgtcatggctggtg

SEQ ID NO: 106 - DNA, 33 bp, Homo sapiens
catgaattcggtggccagattgtcagcagggag

SEQ ID NO: 107 - DNA, 31 bp, Homo sapiens
ctgaagcttccagcccacagcaatggagcca

SEQ ID NO: 108 - DNA, 36 bp, Homo sapiens
caggaattcatttttgagggaattgccagggatctg

SEQ ID NO: 109 - DNA, 29 bp, Homo sapiens
atcgccatgagcccttgcgggcccctcaa

SEQ ID NO: 110 - DNA, 33 bp, Homo sapiens
ttggaattcgaagtggctgaggccgctgtgccg

SEQ ID NO: 111 - DNA, 31 bp, Homo sapiens
gcaaagcttttccaggcaccccaccatgggc

SEQ ID NO: 112 - DNA, 33 bp, Homo sapiens
ctggaattcaaggtcagcctgtttactggcatc

SEQ ID NO: 113 - DNA, 27 bp, Homo sapiens
atcatcatgtccactcccggggtcaat

SEQ ID NO: 114 - DNA, 37 bp, Homo sapiens
tgcgaattctatacatttttctgataagttcagtgtt

SEQ ID NO: 115 - DNA, 30 bp, Homo sapiens
ctgaagcttcctacagccgttccgggcatg

SEQ ID NO: 116 - DNA, 26 bp, Homo sapiens
cgagaacatcctcagtttctccttgg

SEQ ID NO: 117 - DNA, 32 bp, Homo sapiens
gggaagcttgcgggcaccatgcgtccccacct

SEQ ID NO: 118 - DNA, 33 bp, Homo sapiens
agcgaattcgatgatgctggtcctgcaggtgcc

SEQ ID NO: 119 - DNA, 31 bp, Homo sapiens
gccgaattcagctgggatgttccccaatggc

SEQ ID NO: 120 - DNA, 31 bp, Homo sapiens
cagggatcctgcgtggcccgggctcagagcg

SEQ ID NO: 121 - DNA, 31 bp, Homo sapiens
acggaattcccctcagccatggacatgcttc

SEQ ID NO: 122 - DNA, 29 bp, Homo sapiens
tgggatccccaggcccctacaggtagctg

SEQ ID NO: 123 - DNA, 31 bp, Homo sapiens
gccgaattcagctgccctgcgccggcacccc

SEQ ID NO: 124 - DNA, 31 bp, Homo sapiens
gagggatccacgcagggtgggtaggggaagg

SEQ ID NO: 125 - DNA, 30 bp, Homo sapiens
tctaagcttgcagagcctgacgcaccccag

SEQ ID NO: 126 - DNA, 31 bp, Homo sapiens
cctgaattcctgggggtgacacggggccgcc

SEQ ID NO: 127 - DNA, 30 bp, Homo sapiens
ggcgaattcggaggatggagaaatagcccc

SEQ ID NO: 128 - DNA, 30 bp, Homo sapiens
gtaggatcccctaccattgtgagtagtgta

SEQ ID NO: 129 - DNA, 32 bp, Homo sapiens
ccgaagcttcagggcagaccatgcgcccgcca

SEQ ID NO: 130 - DNA, 33 bp, Homo sapiens
tgggaattcgaccagggagacttcggcttggaa

SEQ ID NO: 131 - DNA, 36 bp, Homo sapiens
gctaagcttgccatgcggacgctgctgcctcccgcg

SEQ ID NO: 132 - DNA, 33 bp, Homo sapiens
gtggaattcgatgaccgaggtctccgtttgcag

SEQ ID NO: 133 - DNA, 29 bp, Homo sapiens
atcaccatgcgtctctccgccggtcccga

SEQ ID NO: 134 - DNA, 25 bp, Homo sapiens
ttgttcacctcgatcatggagaaga

SEQ ID NO: 135 - DNA, 24 bp, Homo sapiens
cgcagtacttcgtcttctccatga

SEQ ID NO: 136 - DNA, 35 bp, Homo sapiens
caagaattcagttgaaacaggaatgaatttgatgg

SEQ ID NO: 137 - DNA, 35 bp, Homo sapiens
acagaattctccagttctcattttcttatccgtac

SEQ ID NO: 138 - DNA, 30 bp, Homo sapiens
gcaaagcttgctcatggattctgggcctct

SEQ ID NO: 139 - DNA, 33 bp, Homo sapiens
tctgaattcaaagatgatggtctcagcggtgcc

SEQ ID NO: 140 - DNA, 35 bp, Homo sapiens; identical to SEQ ID NO: 136

SEQ ID NO: 141 - DNA, 37 bp, Homo sapiens
gccaagatccgcacgaagaagatgacttttgtgatcg

SEQ ID NO: 142 - DNA, 27 bp, Homo sapiens
cataagctttcccgccaccctatcact

SEQ ID NO: 143 - DNA, 28 bp, Homo sapiens
actgaattctgctcaatccagctcccca

SEQ ID NO: 144 - DNA, 31 bp, Homo sapiens
cctcggatatcatggtcccagagccgggccc

SEQ ID NO: 145 - DNA, 32 bp, Homo sapiens
cagctctagattggccagccccaagcccgggt

SEQ ID NO: 146 - DNA, 31 bp, Homo sapiens
cctgaattccagcccgaaatgctgccgccag

SEQ ID NO: 147 - DNA, 26 bp, Homo sapiens
ggtccacgctgatgacgcacaggttc

SEQ ID NO: 148 - DNA, 26 bp, Homo sapiens
gaacctgtgcgtcatcagcgtggacc

SEQ ID NO: 149 - DNA, 28 bp, Homo sapiens
tgcggatccatgagggggtttcttaatg

SEQ ID NO: 150 - DNA, 29 bp, Homo sapiens
cggaagcttctggagcaggtagcagcatg

SEQ ID NO: 151 - DNA, 25 bp, Homo sapiens
tgggcaatagttgtgcattgagcca

SEQ ID NO: 152 - DNA, 26 bp, Homo sapiens
ctaatttggtcctacccagcaatggc

SEQ ID NO: 153 - DNA, 36 bp, Homo sapiens; identical to SEQ ID NO: 60

SEQ ID NO: 154 - DNA, 33 bp, Homo sapiens
aataagcttcaagatggaaaccctttgcctcag

SEQ ID NO: 155 - DNA, 26 bp, Homo sapiens
cgttcatgctgtccttatggctgctc

SEQ ID NO: 156 - DNA, 34 bp, Homo sapiens
gcaggctgtcgacctcgtcctcaccaccatggtc

SEQ ID NO: 157 - DNA, 37 bp, Homo sapiens
aatgggctcacagcctgttagatctgcattgggccac

SEQ ID NO: 158 - DNA, 28 bp, Homo sapiens
taacaggctgtgagcccattcctgtgcg

SEQ ID NO: 159 - DNA, 34 bp, Homo sapiens
ttagaattcgcattccctgcccctgccttctttc

SEQ ID NO: 160 - DNA, 33 bp, Homo sapiens
tgcgaattctaatggcaagtctgtgtcatggtc

SEQ ID NO: 161 - DNA, 33 bp, Homo sapiens
tccggatcccagggtggaagagctttgcttgta

SEQ ID NO: 162 - DNA, 30 bp, Homo sapiens
gtgaagcttgcctctggtgcctgcaggagg

SEQ ID NO: 163 - DNA, 31 bp, Homo sapiens
gcagaattcccggtggcgtgttgtggtgccc

SEQ ID NO: 164 - DNA, 24 bp, Homo sapiens
catgagctggtggatcatgaaggg

SEQ ID NO: 165 - DNA, 24 bp, Homo sapiens
atgaagggcatgcccaggagaaag

SEQ ID NO: 166 - DNA, 30 bp, Homo sapiens
cccaagcttccagccccggaggcgccggac

SEQ ID NO: 167 - DNA, 37 bp, Homo sapiens
tgaaggtgttgacctgtatgacgaccttgacggtggg

SEQ ID NO: 168 - DNA, 37 bp, Homo sapiens
ggtcgtcatacaggtcaacaccttcatgtccttcata

SEQ ID NO: 169 - DNA, 33 bp, Homo sapiens
cacgaattcgtacagcgtctcgcgggtggcatt

SEQ ID NO: 170 - DNA, 26 bp, Homo sapiens
atcaccatgcgcctcaacagctccgc

SEQ ID NO: 171 - DNA, 30 bp, Homo sapiens; identical to SEQ ID NO: 166

SEQ ID NO: 172 - DNA, 37 bp, Homo sapiens; identical to SEQ ID NO: 167

SEQ ID NO: 173 - DNA, 37 bp, Homo sapiens; identical to SEQ ID NO: 168

SEQ ID NO: 174 - DNA, 33 bp, Homo sapiens; identical to SEQ ID NO: 169

SEQ ID NO: 175 - DNA, 34 bp, Homo sapiens
cccaagcttcagtaccatggacagcagcgctgcc

SEQ ID NO: 176 - DNA, 39 bp, Homo sapiens
catcttggtgtatctgacaatcacatacatgaccaggaa

SEQ ID NO: 177 - DNA, 39 bp, Homo sapiens
gtatgtgattgtcagatacaccaagatgaagactgccac

SEQ ID NO: 178 - DNA, 39 bp, Homo sapiens
tacaatctatggaaccttgcctgtattttgttgtagcca

SEQ ID NO: 179 - DNA, 39 bp, Homo sapiens
caaaatacaggcaaggttccatagattgtacactaacat

SEQ ID NO: 180 - DNA, 27 bp, Homo sapiens
cgggcaacggagcagtttctgcttcag

SEQ ID NO: 181 - DNA, 31 bp, Homo sapiens
atggaattctgctgcagcggctcctgagctc

SEQ ID NO: 182 - DNA, 36 bp, Homo sapiens
acggacacagcctgtagataggggatgaccttgcag

SEQ ID NO: 183 - DNA, 37 bp, Homo sapiens
atcccctatctacaggctgtgtccgtgtcagtggcag

SEQ ID NO: 184 - DNA, 30 bp, Homo sapiens
ggaggatccagggcagccctcgctcagggc

SEQ ID NO: 185 - DNA, 32 bp, Homo sapiens
cgcaagcttaggcggtggcgatggggaccgcc

SEQ ID NO: 186 - DNA, 26 bp, Homo sapiens
ggatgtggtcccattccggcagacag

SEQ ID NO: 187 - DNA, 25 bp, Homo sapiens
aggaggcacccactggcagcaggta

SEQ ID NO: 188 - DNA, 33 bp, Homo sapiens
gccgaattccatgactgtctcccactcttcctg

SEQ ID NO: 189 - DNA, 32 bp, Homo sapiens
cgagagaggaagacaaagaagacgctgggcat

SEQ ID NO: 190 - DNA, 32 bp, Homo sapiens
atgcccagcgtcttctttgtcttcctctctcg

SEQ ID NO: 191 - DNA, 32 bp, Homo sapiens
gggagcgcaaagccaagaagaccctagggatc

SEQ ID NO: 192 - DNA, 32 bp, Homo sapiens
gatccctagggtcttcttggctttgcgctccc

SEQ ID NO: 193 - DNA, 37 bp, Homo sapiens
cgagaaaggaaagccaagaaaatcctgggcatcattc

SEQ ID NO: 194 - DNA, 37 bp, Homo sapiens
gaatgatgcccaggattttcttggctttcctttctcg

SEQ ID NO: 195 - DNA, 32 bp, Homo sapiens
agggaacggaaggcaaaacgcatcctggggct

SEQ ID NO: 196 - DNA, 32 bp, Homo sapiens
agccccaggatgcgttttgccttccgttccct

SEQ ID NO: 197 - DNA, 38 bp, Homo sapiens
caagagaacggaaagcaaagactaccctgggattaatc

SEQ ID NO: 198 - DNA, 38 bp, Homo sapiens
gattaatcccagggtagtctttgctttccgttctcttg

SEQ ID NO: 199 - DNA, 34 bp, Homo sapiens
aacgaacagagagccaaaaaggtcctagggattg

SEQ ID NO: 200 - DNA, 34 bp, Homo sapiens
caatccctaggacctttttggctctctgttcgtt

SEQ ID NO: 201 - DNA, 35 bp, Homo sapiens
ggacagagaccaaagcaaagaagaccctgtgcatc

SEQ ID NO: 202 - DNA, 35 bp, Homo sapiens
gatgcacagggtcttctttgctttggtctctgtcc

SEQ ID NO: 203 - DNA, 35 bp, Homo sapiens; identical to SEQ ID NO: 201

SEQ ID NO: 204 - DNA, 35 bp, Homo sapiens; identical to SEQ ID NO: 202

SEQ ID NO: 205 - DNA, 35 bp, Homo sapiens; identical to SEQ ID NO: 201

SEQ ID NO: 206 - DNA, 35 bp, Homo sapiens; identical to SEQ ID NO: 202

SEQ ID NO: 207 - DNA, 35 bp, Homo sapiens; identical to SEQ ID NO: 201

SEQ ID NO: 208 - DNA, 35 bp, Homo sapiens; identical to SEQ ID NO: 202

SEQ ID NO: 209 - DNA, 35 bp, Homo sapiens; identical to SEQ ID NO: 201

SEQ ID NO: 210 - DNA, 35 bp, Homo sapiens; identical to SEQ ID NO: 202

SEQ ID NO: 211 - DNA, 33 bp, Homo sapiens
aaggagcagcgggccaagctcatggtgggcatc

SEQ ID NO: 212 - DNA, 33 bp, Homo sapiens
gatgcccaccatgagcttggcccgctgctcctt

SEQ ID NO: 213 - DNA, 37 bp, Homo sapiens
ctgaaggccaagcttacgctgggcatcctgctgggca

SEQ ID NO: 214 - DNA, 38 bp, Homo sapiens
atgcccagcgtaagcttggccttcagggccttcctgct

SEQ ID NO: 215 - DNA, 35 bp, Homo sapiens
gaacagaaagcaaagaccaccctggggatcatcgt

SEQ ID NO: 216 - DNA, 35 bp, Homo sapiens
cccagggtggtctttgctttctgttctcgcttaaa

SEQ ID NO: 217 - DNA, 37 bp, Homo sapiens; identical to SEQ ID NO: 141

SEQ ID NO: 218 - DNA, 37 bp, Homo sapiens
cgatcacaaaagtcatcttcttcgtgcggatcttggc

SEQ ID NO: 219 - DNA, 37 bp, Homo sapiens
ggccaagatccgaacaaagaagatgacctttgtcatc

SEQ ID NO: 220 - DNA, 38 bp, Homo sapiens
cgatgacaaaggtcatcttctttgttcggatcttggcc

SEQ ID NO: 221 - DNA, 33 bp, Homo sapiens
gctgtggccaagactaagaggatgacgctagtg

SEQ ID NO: 222 - DNA, 33 bp, Homo sapiens
cactagcgtcatcctcttagtcttggccacagc

SEQ ID NO: 223 - DNA, 33 bp, Homo sapiens
cgaaagagaattaaaagaacggtattggtgttg

SEQ ID NO: 224 - DNA, 32 bp, Homo sapiens
aataccgttcttttaattctctttcgggattc

SEQ ID NO: 225 - DNA, 37 bp, Homo sapiens
gccgcaaggatagcaagaccaaagcgctgatcctcac

SEQ ID NO: 226 - DNA, 37 bp, Homo sapiens
gtgaggatcagcgctttggtcttgctatccttgcggc

SEQ ID NO: 227 - DNA, 31 bp, Homo sapiens
cggagaggagggccaaggtgctagtcctggt

SEQ ID NO: 228 - DNA, 31 bp, Homo sapiens
accaggactagcaccttggccctcctctccg

SEQ ID NO: 229 - DNA, 40 bp, Homo sapiens
cgccaagtctcagagcaaaaccaagcgagtggccgtggtg

SEQ ID NO: 230 - DNA, 40 bp, Homo sapiens
caccacggccactcgcttggttttgctctgagacttggcg

SEQ ID NO: 231 - DNA, 33 bp, Homo sapiens
cggtccaccaagacaaagaaggtggtggtggca

SEQ ID NO: 232 - DNA, 33 bp, Homo sapiens
tgccaccaccaccttctttgtcttggtggaccg

SEQ ID NO: 233 - DNA, 37 bp, Homo sapiens
cgcatggacattaggttaaagaagaccctggtcctga

SEQ ID NO: 234 - DNA, 37 bp, Homo sapiens
tcaggaccagggtcttctttaacctaatgtccatgcg

SEQ ID NO: 235 - DNA, 38 bp, Homo sapiens
ggctggatgtgaggttgaagaagaccctagggctagtg

SEQ ID NO: 236 - DNA, 38 bp, Homo sapiens
cactagccctagggtcttcttcaacctcacatccagcc

SEQ ID NO: 237 - DNA, 34 bp, Homo sapiens
gaagaggcatagggcaaagagagtcatcttcacc

SEQ ID NO: 238 - DNA, 34 bp, Homo sapiens
ggtgaagatgactctctttgccctatgcctcttc

SEQ ID NO: 239 - DNA, 41 bp, Homo sapiens
gtaaaaaaaagtacaaggccaagcggctcatttttgtcatc

SEQ ID NO: 240 - DNA, 41 bp, Homo sapiens
gatgacaaaaatgagccgcttggccttgtacttttttttac

SEQ ID NO: 241 - DNA, 37 bp, Homo sapiens
gaagaggcacagggctaagaggcttatcttcaccatc

SEQ ID NO: 242 - DNA, 37 bp, Homo sapiens
gatggtgaagataagcctcttagccctgtgcctcttc

SEQ ID NO: 243 - DNA, 41 bp, Homo sapiens
ccacaacaagaccaaggccaagaggttggtgctcattgtgg

SEQ ID NO: 244 - DNA, 41 bp, Homo sapiens
ccacaatgagcaccaacctcttggccttggtcttgttgtgg

SEQ ID NO: 245 - DNA, 37 bp, Homo sapiens
tccaagcacaaagccaaaaaagtgaccatcactgtcc

SEQ ID NO: 246 - DNA, 37 bp, Homo sapiens
ggacagtgatggtcacttttttggctttgtgcttgga

SEQ ID NO: 247 - DNA, 32 bp, Homo sapiens
gaaggctgtgaaagcccctctggtgctgctgc

SEQ ID NO: 248 - DNA, 32 bp, Homo sapiens
gcagcagcaccagaggggctttcacagccttc

SEQ ID NO: 249 - DNA, 36 bp, Homo sapiens
agaagcgcaaggccaagaagaccacagtcatcctca

SEQ ID NO: 250 - DNA, 36 bp, Homo sapiens
tgaggatgactgtggtcttcttggccttgcgcttct

SEQ ID NO: 251 - DNA, 28 bp, Homo sapiens
gagaaactaaagtcaagaagactctgtg

SEQ ID NO: 252 - DNA, 31 bp, Homo sapiens
ctccttcggtcctcctatcgttgtcagaagt

SEQ ID NO: 253 - DNA, 27 bp, Homo sapiens
gagaagaaagccaatcagatgctcgcc

SEQ ID NO: 254 - DNA, 27 bp, Homo sapiens
ggcgagcatctgagtggctttcttctc

SEQ ID NO: 255 - DNA, 27 bp, Homo sapiens
gagaagaaggcaaaacaaatggtggcc

SEQ ID NO: 256 - DNA, 27 bp, Homo sapiens
ggccaccatttgttttgccttcttctc

SEQ ID NO: 257 - DNA, 33 bp, Homo sapiens
aagaaggagaccaaagttaaaaagaccctgtcg

SEQ ID NO: 258 - DNA, 33 bp, Homo sapiens
cgacagggtctttttaactttggtctccttctt

SEQ ID NO: 259 - DNA, 42 bp, Homo sapiens
cagcgtcgagaagtgaaaaaaacagttttctgcttggttgta

SEQ ID NO: 260 - DNA, 42 bp, Homo sapiens
tacaaccaagcagaaaactgtttttttcacttctcgacgctg

SEQ ID NO: 261 - DNA, 37 bp, Homo sapiens
cagagacgggaagtgaagaaaaccgtcttttgcctgg

SEQ ID NO: 262 - DNA, 37 bp, Homo sapiens
ccaggcaaaagacggttttcttcacttcccgtctctg

SEQ ID NO: 263 - DNA, 32 bp, Homo sapiens
aaatccagccgtcccaaacgggtcctcactgc

SEQ ID NO: 264 - DNA, 32 bp, Homo sapiens
gcagtgaggacccgtttgggacggctggattt

SEQ ID NO: 265 - DNA, 32 bp, Homo sapiens; identical to SEQ ID NO: 263

SEQ ID NO: 266 - DNA, 32 bp, Homo sapiens; identical to SEQ ID NO: 264

SEQ ID NO: 267 - DNA, 30 bp, Homo sapiens
ccaagaaaaagactaaacagacagttctgg

SEQ ID NO: 268 - DNA, 30 bp, Homo sapiens
gccaagcgcaaggtgaaacgcatgatcctc

SEQ ID NO: 269 - DNA, 31 bp, Homo sapiens
gaggatcatgcgtttcaccttgcgcttggcg

SEQ ID NO: 270 - DNA, 31 bp, Homo sapiens
aggctggctcgctccccgctgacgctggtgc

SEQ ID NO: 271 - DNA, 31 bp, Homo sapiens
gcaccagcgtcagcggggagcgagccagcct

SEQ ID NO: 272 - DNA, 30 bp, Homo sapiens
cggcgccaccgcacgaaaaagctcatcttc

SEQ ID NO: 273 - DNA, 32 bp, Homo sapiens
ggaagcgacttaagaagacagtgctggtgttt

SEQ ID NO: 274 - DNA, 33 bp, Homo sapiens
cagcactgtcttcttaagtcgcttccgggattc

SEQ ID NO: 275 - DNA, 33 bp, Homo sapiens
aaggagaagaaggcgaaacggaccctgagtgcc

SEQ ID NO: 276 - DNA, 33 bp, Homo sapiens
ggcactcagggtccgtttcgccttcttctcctt

SEQ ID NO: 277 - DNA, 34 bp, Homo sapiens
ccgggaaaagaaagtcaagaggacaatcttggct

SEQ ID NO: 278 - DNA, 34 bp, Homo sapiens
agccaagattgtcctcttgactttcttttcccgg

SEQ ID NO: 279 - DNA, 37 bp, Homo sapiens
ggtcaaggagaagaaagcgaaacagaccctcagtgcg

SEQ ID NO: 280 - DNA, 37 bp, Homo sapiens
cgcactgagggtctgtttcgctttcttctccttgacc

SEQ ID NO: 281 - DNA, 32 bp, Homo sapiens
gggagcgcaaagtgaaacgaacgatctttgcc

SEQ ID NO: 282 - DNA, 32 bp, Homo sapiens
ggcaaagatcgttcgtttcactttgcgctccc

SEQ ID NO: 283 - DNA, 36 bp, Homo sapiens
gtcaaagagaggaaagcaaaacagacactgagtgcc

SEQ ID NO: 284 - DNA, 36 bp, Homo sapiens
ggcactcagtgtctgttttgctttcctctctttgac

SEQ ID NO: 285 - DNA, 37 bp, Homo sapiens
gcaacactcatgtatgaaggggaaagtcaccatcacc

SEQ ID NO: 286 - DNA, 33 bp, Homo sapiens
gccaagcgcaaggtgaagaaaatgatgattgtc

SEQ ID NO: 287 - DNA, 33 bp, Homo sapiens
gacaatcatcattttcttcaccttgcgcttggc

SEQ ID NO: 288 - DNA, 32 bp, Homo sapiens
gccaagaagaagtttaagaagaccatggtgct

SEQ ID NO: 289 - DNA, 32 bp, Homo sapiens
agcaccatggtcttcttaaacttcttcttggc

SEQ ID NO: 290 - DNA, 35 bp, Homo sapiens
ggccaaaagaaaggttaagaaaatgatgattattg

SEQ ID NO: 291 - DNA, 35 bp, Homo sapiens
caataatcatcattttcttaacctttcttttggcc

SEQ ID NO: 292 - DNA, 30 bp, Homo sapiens
cacggaaacgcctgaaaaaaattgtgcttg

SEQ ID NO: 293 - DNA, 30 bp, Homo sapiens
caagcacaatttttttcaggcgtttccgtg

SEQ ID NO: 294 - DNA, 41 bp, Homo sapiens
gaataaaaaagagatcacgaagtgttaagtacagactgacc

SEQ ID NO: 295 - DNA, 39 bp, Homo sapiens
ggtcagtctgtacttaacacttcgtgatctcttttttat

SEQ ID NO: 296 - DNA, 32 bp, Homo sapiens
gccctgcggcacggcaagcgcgtcctacgtgc

SEQ ID NO: 297 - DNA, 32 bp, Homo sapiens
gcacgtaggacgcgcttgccgtgccgcagggc

SEQ ID NO: 298 - DNA, 33 bp, Homo sapiens
agcctccagcgcagcaagcaggttctcagagcc

SEQ ID NO: 299 - DNA, 33 bp, Homo sapiens
ggctctgagaacctgcttgctgcgctggaggct

SEQ ID NO: 300 - DNA, 31 bp, Homo sapiens
gcctgcggcgcatcaagcgcatggtgctggt

SEQ ID NO: 301 - DNA, 31 bp, Homo sapiens
accagcaccatgcgcttgatgcgccgcaggc

SEQ ID NO: 302 - DNA, 32 bp, Homo sapiens
acctgcggcgcatcaagcggctggtgctggtg

SEQ ID NO: 303 - DNA, 32 bp, Homo sapiens
caccagcaccagccgcttgatgcgccgcaggt

SEQ ID NO: 304 - DNA, 32 bp, Homo sapiens
acctgcgtaggatcaagagactggtcctggtg

SEQ ID NO: 305 - DNA, 32 bp, Homo sapiens
caccaggaccagtctcttgatcctacgcaggt

SEQ ID NO: 306 - DNA, 36 bp, Homo sapiens
gggaatcttcgaaggatcaagaggatggtgctggtg

SEQ ID NO: 307 - DNA, 35 bp, Homo sapiens
caccagcaccatcctcttgatccttcgaagattcc

SEQ ID NO: 308 - DNA, 27 bp, Homo sapiens
cgagactgcgtacctgatgattagttc

SEQ ID NO: 309 - DNA, 36 bp, Homo sapiens; identical to SEQ ID NO: 306

SEQ ID NO: 310 - DNA, 28 bp, Homo sapiens
cggaggaagacaaaaaagatgctgatgg

SEQ ID NO: 311 - DNA, 28 bp, Homo sapiens
ccatcagcatcttttttgtcttcctccg

SEQ ID NO: 312 - DNA, 29 bp, Homo sapiens
ccagaaggaaaacaaaacggatgttgatg

SEQ ID NO: 313 - DNA, 31 bp, Homo sapiens
cgactggcccggtcccccctgctgctcatcc

SEQ ID NO: 314 - DNA, 31 bp, Homo sapiens
ggatgagcagcaggggggaccgggccagtcg

SEQ ID NO: 315 - DNA, 32 bp, Homo sapiens
gtcaagcgccgggcgaagtggatggtgtgcac

SEQ ID NO: 316 - DNA, 32 bp, Homo sapiens
gtgcacaccatccacttcgcccggcgcttgac

SEQ ID NO: 317 - DNA, 32 bp, Homo sapiens
cacgacgtggagatgaagggccagcttgtcgg

SEQ ID NO: 318 - DNA, 32 bp, Homo sapiens
ccgacaagctggcccttcatctccacgtcgtg

SEQ ID NO: 319 - DNA, 36 bp, Homo sapiens
gaggagacggaccacaagattctcctggctatcatg

SEQ ID NO: 320 - DNA, 36 bp, Homo sapiens
catgatagccaggagaatcttgtggtccgtctcctc

SEQ ID NO: 321 - DNA, 36 bp, Homo sapiens
gccgagatccagatgaagatcttactcattgccacc

SEQ ID NO: 322 - DNA, 36 bp, Homo sapiens
ggtggcaatgagtaagatcttcatctggatctcggc

SEQ ID NO: 323 - DNA, 33 bp, Homo sapiens
ggaagctgctcaaatccccgctggtgctcatgc

SEQ ID NO: 324 - DNA, 33 bp, Homo sapiens
gcatgagcaccagcggggatttgagcagcttcc

SEQ ID NO: 325 - DNA, 33 bp, Homo sapiens
ggaaactggccaaatcgccactggtcctggtcc

SEQ ID NO: 326 - DNA, 33 bp, Homo sapiens
ggaccaggaccagtggcgatttggccagtttcc

SEQ ID NO: 327 - DNA, 31 bp, Homo sapiens
cgcctggccaggtcccctctcctgctgatcc

SEQ ID NO: 328 - DNA, 31 bp, Homo sapiens
ggatcagcaggagaggggacctggccaggcg

SEQ ID NO: 329 - DNA, 29 bp, Homo sapiens
cgagcgcaagatcaaattaatggtgatgg

SEQ ID NO: 330 - DNA, 32 bp, Homo sapiens
agaagaaggtcaaacgaatggtgtccatcgtg

SEQ ID NO: 331 - DNA, 32 bp, Homo sapiens
ggacaccattcgtttgaccttcttctcagact

SEQ ID NO: 332 - DNA, 30 bp, Homo sapiens
gaacgcagggtcaagcgcatggtggtggcc

SEQ ID NO: 333 - DNA, 29 bp, Homo sapiens
cggagaagaaaatcaaaaggctggtgctg

SEQ ID NO: 334 - DNA, 35 bp, Homo sapiens
tcggagcgaaaggtgaagcgcatggtgttggtggt

SEQ ID NO: 335 - DNA, 35 bp, Homo sapiens
accatgcgcttcacctttcgctccgagcgccgccg

SEQ ID NO: 336 - DNA, 31 bp, Homo sapiens
aggctagccaggtccccactcctgctgatcc

SEQ ID NO: 337 - DNA, 31 bp, Homo sapiens
ggatcagcaggagtggggacctggctagcct

SEQ ID NO: 338 - DNA, 31 bp, Homo sapiens
aggctggccaagtccccgctcctgcttatcc

SEQ ID NO: 339 - DNA, 31 bp, Homo sapiens
ggataagcaggagcggggacttggccagcct

SEQ ID NO: 340 - DNA, 34 bp, Homo sapiens; identical to SEQ ID NO: 156

SEQ ID NO: 341 - DNA, 37 bp, Homo sapiens; identical to SEQ ID NO: 157

SEQ ID NO: 342 - DNA, 28 bp, Homo sapiens
taacaggctgtgagcccattcctgtgcg

SEQ ID NO: 343 - DNA, 34 bp, Homo sapiens; identical to SEQ ID NO: 159

SEQ ID NO: 344 - DNA, 33 bp, Homo sapiens; identical to SEQ ID NO: 160

SEQ ID NO: 345 - DNA, 34 bp, Homo sapiens
tgcggatcctcttcggaagatgttgaggaaagtg

SEQ ID NO: 346 - DNA, 2634 bp, Homo sapiens
atggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaagtgatggatgggcagacagagatgaagtcattgaaggttatgaggtggaagccaacgggggaatcacgataaagctgcagtctccagaggtcaggtcatttgatgattatttcctgaaactgaggctggacactaacacgaggaatccctggttccctgagttctggcaacatcggttccagtgccgccttccaggacaccttctggaaaatcccaactttaaacgaatctgcacaggcaatgaaagcttagaagaaaactatgtccaggacagtaagatggggtttgtcatcaatgccatctatgccatggcacatgggctgcagaacatgcaccatgccctctgccctggccacgtgggcctctgcgatgccatgaagcccatcgacggcagcaagctgctggacttcctcatcaagtcctcattcattggagtatctggagaggaggtgtggtttgatgagaaaggagacgctcctggaaggtatgatatcatgaatctgcagtacactgaagctaatcgctatgactatgtgcacgttggaacctggcatgaaggagtgctgaacattgatgattacaaaatccagatgaacaagagtggagtggtgcggtctgtgtgcagtgagccttgcttaaagggccagattaaggttatacggaaaggagaagtgagctgctgctggatttgcacggcctgcaaagagaatgaatatgtgcaagatgagttcacctgcaaagcttgtgacttgggatggtggcccaatgcagatctaacaggctgtgagcccattcctgtgcgctatcttgagtggagcaacatcgaatccattatagccatcgccttttcatgcctgggaatccttgttaccttgtttgtcaccctaatctttgtactgtaccgggacacaccagtggtcaaatcctccagtcgggagctctgctacatcatcctagctggcatcttccttggttatgtgtgcccattcactctcattgccaaacctactaccacctcctgctacctccagcgcctcttggttggcctctcctctgcgatgtgctactctgctttagtgactaaaaccaatcgtattgcacgcatcctggctggcagcaagaagaagatctgcacccggaagcccaggttcatgagtgcctgggctcaggtgatcattgcctcaattctgattagtgtgcaactaaccctggtggtaaccctgatcatcatggaaccccctatgcccattctgtcctacccaagtatcaaggaagtctaccttatctgcaataccagcaacctgggtgtggtggcccctttgggctacaatggactcctcatcatgagctgtacctactatgccttcaagacccgcaacgtgcccgccaacttcaacgaggccaaatatatcgcgttcaccatgtacaccacctgtatcatctggctagcttttgtgcccatttactttgggagcaactacaagatcatcacaacttgctttgcagtgagtctcagtgtaacagtggctctggggtgcatgttcactcccaagatgtacatcattattgccaagcctgagaggaatgtccgcagtgccttcaccacctctgatgttgtccgcatgcatgttggcgatggcaagctgccctgccgctccaacactttcctcaacatcttccgaaga

SEQ ID NO: 347 - protein, 878 aa, Homo sapiens
MVGLLLFFFPAIFLEVSLLPRSPGRKVLLAGASSQRSVARMDGDVIIGALFSVHHQPPAEKVPERKCGEIREQYGIQRVEAMFHTLDKINADPVLLPNITLGSEIRDSCWHSSVALEQSIEFIRDSLISIRDEKDGINRCLPDGQSLPPGRTKKPIAGVIGPGSSSVAIQVQNLLQLFDIPQIAYSATSIDLSDKTLYKYFLRVVPSDTLQARAMLDIVKRYNWTYVSAVHTEGNYGESGMDAFKELAAQEGLCIAHSDKIYSNAGEKSFDRLLRKLRERLPKARVVVCFCEGMTVRGLLSAMRRLGVVGEFSLIGSDGWADRDEVIEGYEVEANGGITIKLQSPEVRSFDDYFLKLRLDTNTRNPWFPEFWQHRFQCRLPGHLLENPNFKRICTGNESLEENYVQDSKMGFVINAIYAMAHGLQNMHHALCPGHVGLCDAMKPIDGSKLLDFLIKSSFIGVSGEEVWFDEKGDAPGRYDIMNLQYTEANRYDYVHVGTWHEGVLNIDDYKIQMNKSGVVRSVCSEPCLKGQIKVIRKGEVSCCWICTACKENEYVQDEFTCKACDLGWWPNADLTGCEPIPVRYLEWSNIESIIAIAFSCLGILVTLFVTLIFVLYRDTPVVKSSSRELCYIILAGIFLGYVCPFTLIAKPTTTSCYLQRLLVGLSSAMCYSALVTKTNRIARILAGSKKKICTRKPRFMSAWAQVIIASILISVQLTLVVTLIIMEPPMPILSYPSIKEVYLICNTSNLGVVAPLGYNGLLIMSCTYYAFKTRNVPANFNEAKYIAFTMYTTCIIWLAFVPIYFGSNYKIITTCFAVSLSVTVALGCMFTPKMYIIIAKPERNVRSAFTTSDVVRMHVGDGKLPCRSNTFLNIFRR

SEQ ID NO: 348 - DNA, 31 bp, Homo sapiens
agagggtgaaacgcacagccatcgccatctg

SEQ ID NO: 349 - DNA, 31 bp, Homo sapiens; identical to SEQ ID NO: 252

SEQ ID NO: 350 - DNA, 1062 bp, Homo sapiens
atggacctggaagcctcgctgctgcccactggtcccaatgccagcaacacctctgatggccccgataacctcacttcggcaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcggtagtagatctcctctttctcctgggcatgcccttcatgatccaccagctcatgggcaatggggtgtggcactttggggagaccatgtgcaccctcatcacggccatggatgccaatagtcagttcaccagcacctacatcctgaccgccatggccattgaccgctacctggccactgtccaccccatctcttccacgaagttccggaagccctctgtggccaccctggtgatctgcctcctgtgggccctctccttcatcagcatcacccctgtgtggctgtatgccagactcatccccttcccaggaggtgcagtgggctgcggcatacgcctgcccaacccagacactgacctctactggttcaccctgtaccagtttttcctggcctttgccctgccttttgtggtcatcacagccgcatacgtgaggatcctgcagcgcatgacgtcctcagtggcccccgcctcccagcgcagcatccggctgcggacaaagagggtgaaacgcacagccatcgccatctgtctggtcttctttgtgtgctgggcaccctactatgtgctacagctgacccagttgtccatcagccgcccgaccctcacctttgtctacttatacaatgcggccatcagcttgggctatgccaacagctgcctcaacccctttgtgtacatcgtgctctgtgagacgttccgcaaacgcttggtcctgtcggtgaagcctgcagcccaggggcagcttcgcgctgtcagcaacgctcagacggctgacgaggagaggacagaaagcaaaggcacctga

SEQ ID NO: 351 - protein, 353 aa, Homo sapiens
MDLEASLLPTGPNASNTSDGPDNLTSAGSPPRTGSISYINIIMPSVFGTICLLGIIGNSTVIFAVVKKSKLHWCNNVPDIFIINLSVVDLLFLLGMPFMIHQLMGNGVWHFGETMCTLITAMDANSQFTSTYILTAMAIDRYLATVHPISSTKFRKPSVATLVICLLWALSFISITPVWLYARLIPFPGGAVGCGIRLPNPDTDLYWFTLYQFFLAFALPFVVITAAYVRILQRMTSSVAPASQRSIRLRTKRVKRTAIAICLVFFVCWAPYYVLQLTQLSISRPTLTFVYLYNAAISLGYANSCLNPFVYIVLCETFRKRLVLSVKPAAQGQLRAVSNAQTADEERTESKGT

SEQ ID NO: 352 - DNA, 31 bp, Homo sapiens
agagggtgaaacgcagagccatcgccatctg

SEQ ID NO: 353 - DNA, 31 bp, Homo sapiens
cagatggcgatggctctgcgtttcaccctct

SEQ ID NO: 354 - DNA, 1062 bp, Homo sapiens
atggacctggaagcctcgctgctgcccactggtcccaatgccagcaacacctctgatggccccgataacctcacttcggcaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcggtagtagatctcctctttctcctgggcatgcccttcatgatccaccagctcatgggcaatggggtgtggcactttggggagaccatgtgcaccctcatcacggccatggatgccaatagtcagttcaccagcacctacatcctgaccgccatggccattgaccgctacctggccactgtccaccccatctcttccacgaagttccggaagccctctgtggccaccctggtgatctgcctcctgtgggccctctccttcatcagcatcacccctgtgtggctgtatgccagactcatccccttcccaggaggtgcagtgggctgcggcatacgcctgcccaacccagacactgacctctactggttcaccctgtaccagtttttcctggcctttgccctgccttttgtggtcatcacagccgcatacgtgaggatcctgcagcgcatgacgtcctcagtggcccccgcctcccagcgcagcatccggctgcggacaaagagggtgaaacgccaggccatcgccatctgtctggtcttctttgtgtgctgggcaccctactatgtgctacagctgacccagttgtccatcagccgcccgaccctcacctttgtctacttatacaatgcggccatcagcttgggctatgccaacagctgcctcaacccctttgtgtacatcgtgctctgtgagacgttccgcaaacgcttggtcctgtcggtgaagcctgcagcccaggggcagcttcgcgctgtcagcaacgctcagacggctgacgaggagaggacagaaagcaaaggcacctga

SEQ ID NO: 355 - protein, 353 aa, Homo sapiens
MDLEASLLPTGPNASNTSDGPDNLTSAGSPPRTGSISYINIIMPSVFGTICLLGIIGNSTVIFAVVKKSKLHWCNNVPDIFIINLSVVDLLFLLGMPFMIHQLMGNGVWHFGETMCTLITAMDANSQFTSTYILTAMAIDRYLATVHPISSTKFRKPSVATLVICLLWALSFISITPVWLYARLIPFPGGAVGCGIRLPNPDTDLYWFTLYQFFLAFALPFVVITAAYVRILQRMTSSVAPASQRSIRLRTKRVKRKAIAICLVFFVCWAPYYVLQLTQLSISRPTLTFVYLYNAAISLGYANSCLNPFVYIVLCETFRKRLVLSVKPAAQGQLRAVSNAQTADEERTESKGT

SEQ ID NO: 356 - DNA, 70 bp, Homo sapiens
gatcctgcagaaggtgaagtcctctggaatccgagtgggctcctctaagaggaagaagtctgagaagaag

SEQ ID NO: 357 - DNA, 71 bp, Homo sapiens
gtgaccttcttctcagacttcttcctcttagaggagcccactcggattccagaggacttcaccttctgcag

SEQ ID NO: 358 - DNA, 1349 bp, Homo sapiens
atggacctggaagcctcgctgctgcccactggtcccaatgccagcaacacctctgatggccccgataacctcacttcggcaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcggtagtagatctcctctttctcctgggcatgcccttcatgatccaccagctcatgggcaatggggtgtggcactttggggagaccatgtgcaccctcatcacggccatggatgccaatagtcagttcaccagcacctacatcctgaccgccatggccattgaccgctacctggccactgtccaccccatctcttccacgaagttccggaagccctctgtggccaccctggtgatctgcctcctgtgggccctctccttcatcagcatcacccctgtgtggctgtatgccagactcatccccttcccaggaggtgcagtgggctgcggcatacgcctgcccaacccagacactgacctctactggttcaccctgtaccagtttttcctggcctttgccctgccttttgtggtcatcacagccgcatacgtgaggatcctgcagaaggtgaagtcctctggaatccgagtgggctcctctaagaggaagaagtctgagaagaaggtcacccgcacagccatcgccatctgtctggtcttctttgtgtgctgggcaccctactatgtgctacagctgacccagttgtccatcagccgcccgaccctcacctttgtctacttatacaatgcggccatcagcttgggctatgccaacagctgcctcaacccctttgtgtacatcgtgctctgtgagacgttccgcaaacgcttggtcctgtcggtgaagcctgcagcccaggggcagcttcgcgctgtcagcaacgctcagacggctgacgaggagaggacagaaagcaaaggcacctgatacttcccctgccaccctgcacacctccaagtcagggcaccacaacacgccaccgggagagatgctgagaaaaacccaagaccgctcgggaaatgcaggaaggccgggttgtgaggggttgttgcaatgaaataaatacattccatgggctcacacgttgctggggaggcctggagtcaggtttggggttttcagatatcagaaatcccttgggggagcaggatgagacctttggatagaacagaagctgagcaagagaacatgttggtttggataaccggttgcac

SEQ ID NO: 359 - protein, 446 aa, Homo sapiens
MDLEASLLPTGPNASNTSDGPDNLTSAGSPPRTGSISYINIIMPSVFGTICLLGIIGNSTVIFAVVKKSKLHWCNNVPDIFIINLSVVDLLFLLGMPFMIHQLMGNGVWHFGETMCTLITAMDANSQFTSTYILTAMAIDRYLATVHPISSTKFRKPSVATLVICLLWALSFISITPVWLYARLIPFPGGAVGCGIRLPNPDTDLYWFTLYQFFLAFALPFVVITAAYVRILQKVKSSGIRVGSSKRKKSEKKVTRTAIAICLVFFVCWAPYYVLQLTQLSISRPTLTFVYLYNAAISLGYANSCLNPFVYIVLCETFRKRLVLSVKPAAQGQLRAVSNAQTADEERTESKGTYFPCHPAHLQVRAPQHATGRDAEKNPRPLGKCRKAGLGVVAMKIHSMGSHVAGEAWSQVWGFQISEIPWGSRMRPLDRTEAEQENMLVWITGC

SEQ ID NO: 360 - DNA, 33 bp, Homo sapiens
ggctatgccaacagctacctcaacccctttgtg

SEQ ID NO: 361 - DNA, 33 bp, Homo sapiens
cacaaaggggttgaggtagctgttggcatagcc

SEQ ID NO: 362 - DNA, 1062 bp, Homo sapiens
atggacctggaagcctcgctgctgcccactggtcccaatgccagcaacacctctgatggccccgataacctcacttcggcaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcggtagtagatctcctctttctcctgggcatgcccttcatgatccaccagctcatgggcaatggggtgtggcactttggggagaccatgtgcaccctcatcacggccatggatgccaatagtcagttcaccagcacctacatcctgaccgccatggccattgaccgctacctggccactgtccaccccatctcttccacgaagttccggaagccctctgtggccaccctggtgatctgcctcctgtgggccctctccttcatcagcatcacccctgtgtggctgtatgccagactcatccccttcccaggaggtgcagtgggctgcggcatacgcctgcccaacccagacactgacctctactggttcaccctgtaccagtttttcctggcctttgccctgccttttgtggtcatcacagccgcatacgtgaggatcctgcagcgcatgacgtcctcagtggcccccgcctcccagcgcagcatccggctgcggacaaagagggtgacccgcacagccatcgccatctgtctggtcttctttgtgtgctgggcaccctactatgtgctacagctgacccagttgtccatcagccgcccgaccctcacctttgtctacttatacaatgcggccatcagcttgggctatgccaacagctacctcaacccctttgtgtacatcgtgctctgtgagacgttccgcaaacgcttggtcctgtcggtgaagcctgcagcccaggggcagcttcgcgctgtcagcaacgctcagacggctgacgaggagaggacagaaagcaaaggcacctga

SEQ ID NO: 363 - protein, 353 aa, Homo sapiens
MDLEASLLPTGPNASNTSDGPDNLTSAGSPPRTGSISYINIIMPSVFGTICLLGIIGNSTVIFAVVKKSKLHWCNNVPDIFIINLSVVDLLFLLGMPFMIHQLMGNGVWHFGETMCTLITAMDANSQFTSTYILTAMAIDRYLATVHPISSTKFRKPSVATLVICLLWALSFISITPVWLYARLIPFPGGAVGCGIRLPNPDTDLYWFTLYQFFLAFALPFVVITAAYVRILQRMTSSVAPASQRSIRLRTKRVTRTAIAICLVFFVCWAPYYVLQLTQLSISRPTLTFVYLYNAAISLGYANSYLNPFVYIVLCETFRKRLVLSVKPAAQGQLRAVSNAQTADEERTESKGT

SEQ ID NO: 364 - DNA, 33 bp, Homo sapiens
ttgtgtgctgggcactctactatgtgctacagc

SEQ ID NO: 365 - DNA, 33 bp, Homo sapiens
gctgtagcacatagtagagtgcccagcacacaa

SEQ ID NO: 366 - DNA, 1062 bp, Homo sapiens
atggacctggaagcctcgctgctgcccactggtcccaatgccagcaacacctctgatggccccgataacctcacttcggcaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcggtagtagatctcctctttctcctgggcatgcccttcatgatccaccagctcatgggcaatggggtgtggcactttggggagaccatgtgcaccctcatcacggccatggatgccaatagtcagttcaccagcacctacatcctgaccgccatggccattgaccgctacctggccactgtccaccccatctcttccacgaagttccggaagccctctgtggccaccctggtgatctgcctcctgtgggccctctccttcatcagcatcacccctgtgtggctgtatgccagactcatccccttcccaggaggtgcagtgggctgcggcatacgcctgcccaacccagacactgacctctactggttcaccctgtaccagtttttcctggcctttgccctgccttttgtggtcatcacagccgcatacgtgaggatcctgcagcgcatgacgtcctcagtggcccccgcctcccagcgcagcatccggctgcggacaaagagggtgacccgcacagccatcgccatctgtctggtcttctttgtgtgctgggcactctactatgtgctacagctgacccagttgtccatcagccgcccgaccctcacctttgtctacttatacaatgcggccatcagcttgggctatgccaacagctgcctcaacccctttgtgtacatcgtgctctgtgagacgttccgcaaacgcttggtcctgtcggtgaagcctgcagcccaggggcagcttcgcgctgtcagcaacgctcagacggctgacgaggagaggacagaaagcaaaggcacctga

SEQ ID NO: 367 - protein, 353 aa, Homo sapiens
MDLEASLLPTGPNASNTSDGPDNLTSAGSPPRTGSISYINIIMPSVFGTICLLGIIGNSTVIFAVVKKSKLHWCNNVPDIFIINLSVVDLLFLLGMPFMIHQLMGNGVWHFGETMCTLITAMDANSQFTSTYILTAMAIDRYLATVHPISSTKFRKPSVATLVICLLWALSFISITPVWLYARLIPFPGGAVGCGIRLPNPDTDLYWFTLYQFFLAFALPFVVITAAYVRILQRMTSSVAPASQRSIRLRTKRVTRTAIAICLVFFVCWALYYVLQLTQLSISRPTLTFVYLYNAAISLGYANSCLNPFVYIVLCETFRKRLVLSVKPAAQGQLRAVSNAQTADEERTESKGT

SEQ ID NO: 368 - DNA, 34 bp, Homo sapiens
ggtcttctttgtgtgctgcgcaccctactatgtg

SEQ ID NO: 369 - DNA, 34 bp, Homo sapiens
cacatagtagggtgcgcagcacacaaagaagacc

SEQ ID NO: 370 - DNA, 1062 bp, Homo sapiens
atggacctggaagcctcgctgctgcccactggtcccaatgccagcaacacctctgatggccccgataacctcacttcggcaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcggtagtagatctcctctttctcctgggcatgcccttcatgatccaccagctcatgggcaatggggtgtggcactttggggagaccatgtgcaccctcatcacggccatggatgccaatagtcagttcaccagcacctacatcctgaccgccatggccattgaccgctacctggccactgtccaccccatctcttccacgaagttccggaagccctctgtggccaccctggtgatctgcctcctgtgggccctctccttcatcagcatcacccctgtgtggctgtatgccagactcatccccttcccaggaggtgcagtgggctgcggcatacgcctgcccaacccagacactgacctctactggttcaccctgtaccagtttttcctggcctttgccctgccttttgtggtcatcacagccgcatacgtgaggatcctgcagcgcatgacgtcctcagtggcccccgcctcccagcgcagcatccggctgcggacaaagagggtgacccgcacagccatcgccatctgtctggtcttctttgtgtgctgcgcaccctactatgtgctacagctgacccagttgtccatcagccgcccgaccctcacctttgtctacttatacaatgcggccatcagcttgggctatgccaacagctgcctcaacccctttgtgtacatcgtgctctgtgagacgttccgcaaacgcttggtcctgtcggtgaagcctgcagcccaggggcagcttcgcgctgtcagcaacgctcagacggctgacgaggagaggacagaaagcaaaggcacctga

SEQ ID NO: 371 - protein, 353 aa, Homo sapiens
MDLEASLLPTGPNASNTSDGPDNLTSAGSPPRTGSISYINIIMPSVFGTICLLGIIGNSTVIFAVVKKSKLHWCNNVPDIFIINLSVVDLLFLLGMPFMIHQLMGNGVWHFGETMCTLITAMDANSQFTSTYILTAMAIDRYLATVHPISSTKFRKPSVATLVICLLWALSFISITPVWLYARLIPFPGGAVGCGIRLPNPDTDLYWFTLYQFFLAFALPFVVITAAYVRILQRMTSSVAPASQRSIRLRTKRVTRTAIAICLVFFVCCAPYYVLQLTQLSISRPTLTFVYLYNAAISLGYANSCLNPFVYIVLCETFRKRLVLSVKPAAQGQLRAVSNAQTADEERTESKGT

SEQ ID NO: 372 - DNA, 34 bp, Homo sapiens
ggtcttctttgtgtgcttcgcaccctactatgtg

SEQ ID NO: 373 - DNA, 34 bp, Homo sapiens
cacatagtagggtgcgaagcacacaaagaagacc

SEQ ID NO: 374 - DNA, 1062 bp, Homo sapiens
atggacctggaagcctcgctgctgcccactggtcccaatgccagcaacacctctgatggccccgataacctcacttcggcaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcggtagtagatctcctctttctcctgggcatgcccttcatgatccaccagctcatgggcaatggggtgtggcactttggggagaccatgtgcaccctcatcacggccatggatgccaatagtcagttcaccagcacctacatcctgaccgccatggccattgaccgctacctggccactgtccaccccatctcttccacgaagttccggaagccctctgtggccaccctggtgatctgcctcctgtgggccctctccttcatcagcatcacccctgtgtggctgtatgccagactcatccccttcccaggaggtgcagtgggctgcggcatacgcctgcccaacccagacactgacctctactggttcaccctgtaccagtttttcctggcctttgccctgccttttgtggtcatcacagccgcatacgtgaggatcctgcagcgcatgacgtcctcagtggcccccgcctcccagcgcagcatccggctgcggacaaagagggtgacccgcacagccatcgccatctgtctggtcttctttgtgtgcttcgcaccctactatgtgctacagctgacccagttgtccatcagccgcccgaccctcacctttgtctacttatacaatgcggccatcagcttgggctatgccaacagctgcctcaacccctttgtgtacatcgtgctctgtgagacgttccgcaaacgcttggtcctgtcggtgaagcctgcagcccaggggcagcttcgcgctgtcagcaacgctcagacggctgacgaggagaggacagaaagcaaaggcacctga

SEQ ID NO: 375 - protein, 353 aa, Homo sapiens
MDLEASLLPTGPNASNTSDGPDNLTSAGSPPRTGSISYINIIMPSVFGTICLLGIIGNSTVIFAVVKKSKLHWCNNVPDIFIINLSVVDLLFLLGMPFMIHQLMGNGVWHFGETMCTLITAMDANSQFTSTYILTAMAIDRYLATVHPISSTKFRKPSVATLVICLLWALSFISITPVWLYARLIPFPGGAVGCGIRLPNPDTDLYWFTLYQFFLAFALPFVVITAAYVRILQRMTSSVAPASQRSIRLRTKRVTRTAIAICLVFFVCFAPYYVLQLTQLSISRPTLTFVYLYNAAISLGYANSCLNPFVYIVLCETFRKRLVLSVKPAAQGQLRAVSNAQTADEERTESKGT

SEQ ID NO: 376 - DNA, 34 bp, Homo sapiens
ggtcttctttgtgtgcttggcaccctactatgtg

SEQ ID NO: 377 - DNA, 34 bp, Homo sapiens
cacatagtagggtgccaagcacacaaagaagacc

SEQ ID NO: 378 - DNA, 1062 bp, Homo sapiens
atggacctggaagcctcgctgctgcccactggtcccaatgccagcaacacctctgatggccccgataacctcacttcggcaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcggtagtagatctcctctttctcctgggcatgcccttcatgatccaccagctcatgggcaatggggtgtggcactttggggagaccatgtgcaccctcatcacggccatggatgccaatagtcagttcaccagcacctacatcctgaccgccatggccattgaccgctacctggccactgtccaccccatctcttccacgaagttccggaagccctctgtggccaccctggtgatctgcctcctgtgggccctctccttcatcagcatcacccctgtgtggctgtatgccagactcatccccttcccaggaggtgcagtgggctgcggcatacgcctgcccaacccagacactgacctctactggttcaccctgtaccagtttttcctggcctttgccctgccttttgtggtcatcacagccgcatacgtgaggatcctgcagcgcatgacgtcctcagtggcccccgcctcccagcgcagcatccggctgcggacaaagagggtgacccgcacagccatcgccatctgtctggtcttctttgtgtgcttggcaccctactatgtgctacagctgacccagttgtccatcagccgcccgaccctcacctttgtctacttatacaatgcggccatcagcttgggctatgccaacagctgcctcaacccctttgtgtacatcgtgctctgtgagacgttccgcaaacgcttggtcctgtcggtgaagcctgcagcccaggggcagcttcgcgctgtcagcaacgctcagacggctgacgaggagaggacagaaagcaaaggcacctga

SEQ ID NO: 379 - protein, 353 aa, Homo sapiens
MDLEASLLPTGPNASNTSDGPDNLTSAGSPPRTGSISYINIIMPSVFGTICLLGIIGNSTVIFAVVKKSKLHWCNNVPDIFIINLSVVDLLFLLGMPFMIHQLMGNGVWHFGETMCTLITAMDANSQFTSTYILTAMAIDRYLATVHPISSTKFRKPSVATLVICLLWALSFISITPVWLYARLIPFPGGAVGCGIRLPNPDTDLYWFTLYQFFLAFALPFVVITAAYVRILQRMTSSVAPASQRSIRLRTKRVTRTAIAICLVFFVCLAPYYVLQLTQLSISRPTLTFVYLYNAAISLGYANSCLNPFVYIVLCETFRKRLVLSVKPAAQGQLRAVSNAQTADEERTESKGT

SEQ ID NO: 380 - DNA, 31 bp, Homo sapiens
gccatctgtctggtcatctttgtgtgctggg

SEQ ID NO: 381 - DNA, 31 bp, Homo sapiens
cccagcacacaaagatgaccagacagatggc

SEQ ID NO: 382 - DNA, 1062 bp, Homo sapiens
atggacctggaagcctcgctgctgcccactggtcccaatgccagcaacacctctgatggccccgataacctcacttcggcaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcggtagtagatctcctctttctcctgggcatgcccttcatgatccaccagctcatgggcaatggggtgtggcactttggggagaccatgtgcaccctcatcacggccatggatgccaatagtcagttcaccagcacctacatcctgaccgccatggccattgaccgctacctggccactgtccaccccatctcttccacgaagttccggaagccctctgtggccaccctggtgatctgcctcctgtgggccctctccttcatcagcatcacccctgtgtggctgtatgccagactcatccccttcccaggaggtgcagtgggctgcggcatacgcctgcccaacccagacactgacctctactggttcaccctgtaccagtttttcctggcctttgccctgccttttgtggtcatcacagccgcatacgtgaggatcctgcagcgcatgacgtcctcagtggcccccgcctcccagcgcagcatccggctgcggacaaagagggtgacccgcacagccatcgccatctgtctggtcatctttgtgtgctgggcaccctactatgtgctacagctgacccagttgtccatcagccgcccgaccctcacctttgtctacttatacaatgcggccatcagcttgggctatgccaacagctgcctcaacccctttgtgtacatcgtgctctgtgagacgttccgcaaacgcttggtcctgtcggtgaagcctgcagcccaggggcagcttcgcgctgtcagcaacgctcagacggctgacgaggagaggacagaaagcaaaggcacctga

SEQ ID NO: 383 - protein, 353 aa, Homo sapiens
MDLEASLLPTGPNASNTSDGPDNLTSAGSPPRTGSISYINIIMPSVFGTICLLGIIGNSTVIFAVVKKSKLHWCNNVPDIFIINLSVVDLLFLLGMPFMIHQLMGNGVWHFGETMCTLITAMDANSQFTSTYILTAMAIDRYLATVHPISSTKFRKPSVATLVICLLWALSFISITPVWLYARLIPFPGGAVGCGIRLPNPDTDLYWFTLYQFFLAFALPFVVITAAYVRILQRMTSSVAPASQRSIRLRTKRVTRTAIAICLVIFVCWAPYYVLQLTQLSISRPTLTFVYLYNAAISLGYANSCLNPFVYIVLCETFRKRLVLSVKPAAQGQLRAVSNAQTADEERTESKGT

SEQ ID NO: 384 - DNA, 36 bp, Homo sapiens
cgcacagccatcgcccagtgtctggtcttctttgtg

SEQ ID NO: 385 - DNA, 36 bp, Homo sapiens
cacaaagaagaccagacactgggcgatggctgtgcg

SEQ ID NO: 386 - DNA, 1062 bp, Homo sapiens
atggacctggaagcctcgctgctgcccactggtcccaatgccagcaacacctctgatggccccgataacctcacttcggcaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcggtagtagatctcctctttctcctgggcatgcccttcatgatccaccagctcatgggcaatggggtgtggcactttggggagaccatgtgcaccctcatcacggccatggatgccaatagtcagttcaccagcacctacatcctgaccgccatggccattgaccgctacctggccactgtccaccccatctcttccacgaagttccggaagccctctgtggccaccctggtgatctgcctcctgtgggccctctccttcatcagcatcacccctgtgtggctgtatgccagactcatccccttcccaggaggtgcagtgggctgcggcatacgcctgcccaacccagacactgacctctactggttcaccctgtaccagtttttcctggcctttgccctgccttttgtggtcatcacagccgcatacgtgaggatcctgcagcgcatgacgtcctcagtggcccccgcctcccagcgcagcatccggctgcggacaaagagggtgacccgcacagccatcgcccagtgtctggtcttctttgtgtgctgggcaccctactatgtgctacagctgacccagttgtccatcagccgcccgaccctcacctttgtctacttatacaatgcggccatcagcttgggctatgccaacagctgcctcaacccctttgtgtacatcgtgctctgtgagacgttccgcaaacgcttggtcctgtcggtgaagcctgcagcccaggggcagcttcgcgctgtcagcaacgctcagacggctgacgaggagaggacagaaagcaaaggcacctga

SEQ ID NO: 387 - protein, 353 aa, Homo sapiens
MDLEASLLPTGPNASNTSDGPDNLTSAGSPPRTGSISYINIIMPSVFGTICLLGIIGNSTVIFAVVKKSKLHWCNNVPDIFIINLSVVDLLFLLGMPFMIHQLMGNGVWHFGETMCTLITAMDANSQFTSTYILTAMAIDRYLATVHPISSTKFRKPSVATLVICLLWALSFISITPVWLYARLIPFPGGAVGCGIRLPNPDTDLYWFTLYQFFLAFALPFVVITAAYVRILQRMTSSVAPASQRSIRLRTKRVTRTAIAQCLVFFVCWAPYYVLQLTQLSISRPTLTFVYLYNAAISLGYANSCLNPFVYIVLCETFRKRLVLSVKPAAQGQLRAVSNAQTADEERTESKGT

SEQ ID NO: 388 - DNA, 33 bp, Homo sapiens
accgccatggccattaacgcgtacctggccact

SEQ ID NO: 389 - DNA, 33 bp, Homo sapiens
agtggccaggtagcggttaatggccatggcggt

SEQ ID NO: 390 - DNA, 1062 bp, Homo sapiens
atggacctggaagcctcgctgctgcccactggtcccaatgccagcaacacctctgatggccccgataacctcacttcggcaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcggtagtagatctcctctttctcctgggcatgcccttcatgatccaccagctcatgggcaatggggtgtggcactttggggagaccatgtgcaccctcatcacggccatggatgccaatagtcagttcaccagcacctacatcctgaccgccatggccattaaccgctacctggccactgtccaccccatctcttccacgaagttccggaagccctctgtggccaccctggtgatctgcctcctgtgggccctctccttcatcagcatcacccctgtgtggctgtatgccagactcatccccttcccaggaggtgcagtgggctgcggcatacgcctgcccaacccagacactgacctctactggttcaccctgtaccagtttttcctggcctttgccctgccttttgtggtcatcacagccgcatacgtgaggatcctgcagcgcatgacgtcctcagtggcccccgcctcccagcgcagcatccggctgcggacaaagagggtgacccgcacagccatcgccatctgtctggtcttctttgtgtgctgggcaccctactatgtgctacagctgacccagttgtccatcagccgcccgaccctcacctttgtctacttatacaatgcggccatcagcttgggctatgccaacagctgcctcaacccctttgtgtacatcgtgctctgtgagacgttccgcaaacgcttggtcctgtcggtgaagcctgcagcccaggggcagcttcgcgctgtcagcaacgctcagacggctgacgaggagaggacagaaagcaaaggcacctga

SEQ ID NO: 391 - protein, 353 aa, Homo sapiens
MDLEASLLPTGPNASNTSDGPDNLTSAGSPPRTGSISYINIIMPSVFGTICLLGIIGNSTVIFAVVKKSKLHWCNNVPDIFIINLSVVDLLFLLGMPFMIHQLMGNGVWHFGETMCTLITAMDANSQFTSTYILTAMAINRYLATVHPISSTKFRKPSVATLVICLLWALSFISITPVWLYARLIPFPGGAVGCGIRLPNPDTDLYWFTLYQFFLAFALPFVVITAAYVRILQRMTSSVAPASQRSIRLRTKRVTRTAIAICLVFFVCWAPYYVLQLTQLSISRPTLTFVYLYNAAISLGYANSCLNPFVYIVLCETFRKRLVLSVKPAAQGQLRAVSNAQTADEERTESKGT

SEQ ID NO: 392 - DNA, 32 bp, Homo sapiens
caagcgagttatcggcatatacgctgacggtc

SEQ ID NO: 393 - DNA, 32 bp, Homo sapiens
gaccgtcagcgtatatgccgataactcgcttg

SEQ ID NO: 394 - DNA, 2292 bp, Homo sapiens
atgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaacggctttacttcagtccaaggatatgctttcaatgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacacctggactcttaagaaacttccactttccttgagtttccttcacctcacacgggctgacctttcttacccaagccactgctgtgcctttaagaatcagaagaaaatcagaggaatccttgagtccttgatgtgtaatgagagcagtatgcagagcttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggctacaagttcctgagaattgtggtgtggttcgttagtctgctggctctcctgggcaatgtctttgtcctgcttattctcctcaccagccactacaaactgaacgtcccccgctttctcatgtgcaacctggcctttgcggatttctgcatggggatgtacctgctcctcatcgcctctgtagacctctacactcactctgagtactacaaccatgccatcgactggcagacaggccctgggtgcaacacggctggtttcttcactgtctttgcaagcgagttatcggtgcatacgctgacggtcatcaccctggagcgctggtatgccatcaccttcgccatgcgcctggaccggaagatccgcctcaggcacgcatgtgccatcatggttgggggctgggtttgctgcttccttctcgccctgcttcctttggtgggaataagtagctatgccaaagtcagtatctgcctgcccatggacaccgagacccctcttgctctggcatatattgtttttgttctgacgctcaacatagttgccttcgtcatcgtctgctgctgttatgtgaagatctacatcacagtccgaaatccgcagtacaacccaggggacaaagataccaaaattgccaagaggatggctgtgttgatcttcaccgacttcatatgcatggccccaatctcattctatgctctgtcagcaattctgaacaagcctctcatcactgttagcaactccaaaatcttgctggtactcttctatccacttaactcctgtgccaatccattcctctatgctattttcaccaaggccttccagagggatgtgttcatcctactcagcaagtttggcatctgtaaacgccaggctcaggcataccgggggcagagggttcctccaaagaacagcactgatattcaggttcaaaaggttacccacgagatgaggcagggtctccacaacatggaagatgtctatgaactgattgaaaagtcccatctaaccccaaagaagcaaggccaaatctcagaagagtatatgcaaacggttttg

SEQ ID NO: 395 - protein, 764 aa, Homo sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMGYKFLRIVVWFVSLLALLGNVFVLLILLTSHYKLNVPRFLMCNLAFADFCMGMYLLLIASVDLYTHSEYYNHAIDWQTGPGCNTAGFFTVFASELSAYTLTVITLERWYAITFAMRLDRKIRLRHACAIMVGGWVCCFLLALLPLVGISSYAKVSICLPMDTETPLALAYIVFVLTLNIVAFVIVCCCYVKIYITVRNPQYNPGDKDTKIAKRMAVLIFTDFICMAPISFYALSAILNKPLITVSNSKILLVLFYPLNSCANPFLYAIFTKAFQRDVFILLSKFGICKRQAQAYRGQRVPPKNSTDIQVQKVTHEMRQGLHNMEDVYELIEKSHLTPKKQGQISEEYMQTVL

SEQ ID NO: 396 - DNA, 31 bp, Homo sapiens
acccaggggacaaaggtaccaaaattgccaa

SEQ ID NO: 397 - DNA, 31 bp, Homo sapiens
ttggcaattttggtacctttgtcccctgggt

SEQ ID NO: 398 - DNA, 2292 bp, Homo sapiens
atgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaacggctttacttcagtccaaggatatgctttcaatgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacacctggactcttaagaaacttccactttccttgagtttccttcacctcacacgggctgacctttcttacccaagccactgctgtgcctttaagaatcagaagaaaatcagaggaatccttgagtccttgatgtgtaatgagagcagtatgcagagcttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggctacaagttcctgagaattgtggtgtggttcgttagtctgctggctctcctgggcaatgtctttgtcctgcttattctcctcaccagccactacaaactgaacgtcccccgctttctcatgtgcaacctggcctttgcggatttctgcatggggatgtacctgctcctcatcgcctctgtagacctctacactcactctgagtactacaaccatgccatcgactggcagacaggccctgggtgcaacacggctggtttcttcactgtctttgcaagcgagttatcggtgtatacgctgacggtcatcaccctggagcgctggtatgccatcaccttcgccatgcgcctggaccggaagatccgcctcaggcacgcatgtgccatcatggttgggggctgggtttgctgcttccttctcgccctgcttcctttggtgggaataagtagctatgccaaagtcagtatctgcctgcccatggacaccgagacccctcttgctctggcatatattgtttttgttctgacgctcaacatagttgccttcgtcatcgtctgctgctgttatgtgaagatctacatcacagtccgaaatccgcagtacaacccaggggacaaaggtaccaaaattgccaagaggatggctgtgttgatcttcaccgacttcatatgcatggccccaatctcattctatgctctgtcagcaattctgaacaagcctctcatcactgttagcaactccaaaatcttgctggtactcttctatccacttaactcctgtgccaatccattcctctatgctattttcaccaaggccttccagagggatgtgttcatcctactcagcaagtttggcatctgtaaacgccaggctcaggcataccgggggcagagggttcctccaaagaacagcactgatattcaggttcaaaaggttacccacgagatgaggcagggtctccacaacatggaagatgtctatgaactgattgaaaagtcccatctaaccccaaagaagcaaggccaaatctcagaagagtatatgcaaacggttttg

SEQ ID NO: 399 - protein, 764 aa, Homo sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMGYKFLRIVVWFVSLLALLGNVFVLLILLTSHYKLNVPRFLMCNLAFADFCMGMYLLLIASVDLYTHSEYYNHAIDWQTGPGCNTAGFFTVFASELSVYTLTVITLERWYAITFAMRLDRKIRLRHACAIMVGGWVCCFLLALLPLVGISSYAKVSICLPMDTETPLALAYIVFVLTLNIVAFVIVCCCYVKIYITVRNPQYNPGDKGTKIAKRMAVLIFTDFICMAPISFYALSAILNKPLITVSNSKILLVLFYPLNSCANPFLYAIFTKAFQRDVFILLSKFGICKRQAQAYRGQRVPPKNSTDIQVQKVTHEMRQGLHNMEDVYELIEKSHLTPKKQGQISEEYMQTVL

SEQ ID NO: 400 - DNA, 32 bp, Homo sapiens
aaagataccaaaattatcaagaggatggctgt

SEQ ID NO: 401 - DNA, 32 bp, Homo sapiens
acagccatcctcttgataattttggtatcttt

SEQ ID NO: 402 - DNA, 2292 bp, Homo sapiens
atgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaacggctttacttcagtccaaggatatgctttcaatgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacacctggactcttaagaaacttccactttccttgagtttccttcacctcacacgggctgacctttcttacccaagccactgctgtgcctttaagaatcagaagaaaatcagaggaatccttgagtccttgatgtgtaatgagagcagtatgcagagcttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggctacaagttcctgagaattgtggtgtggttcgttagtctgctggctctcctgggcaatgtctttgtcctgcttattctcctcaccagccactacaaactgaacgtcccccgctttctcatgtgcaacctggcctttgcggatttctgcatggggatgtacctgctcctcatcgcctctgtagacctctacactcactctgagtactacaaccatgccatcgactggcagacaggccctgggtgcaacacggctggtttcttcactgtctttgcaagcgagttatcggtgtatacgctgacggtcatcaccctggagcgctggtatgccatcaccttcgccatgcgcctggaccggaagatccgcctcaggcacgcatgtgccatcatggttgggggctgggtttgctgcttccttctcgccctgcttcctttggtgggaataagtagctatgccaaagtcagtatctgcctgcccatggacaccgagacccctcttgctctggcatatattgtttttgttctgacgctcaacatagttgccttcgtcatcgtctgctgctgttatgtgaagatctacatcacagtccgaaatccgcagtacaacccaggggacaaagataccaaaattatcaagaggatggctgtgttgatcttcaccgacttcatatgcatggccccaatctcattctatgctctgtcagcaattctgaacaagcctctcatcactgttagcaactccaaaatcttgctggtactcttctatccacttaactcctgtgccaatccattcctctatgctattttcaccaaggccttccagagggatgtgttcatcctactcagcaagtttggcatctgtaaacgccaggctcaggcataccgggggcagagggttcctccaaagaacagcactgatattcaggttcaaaaggttacccacgagatgaggcagggtctccacaacatggaagatgtctatgaactgattgaaaagtcccatctaaccccaaagaagcaaggccaaatctcagaagagtatatgcaaacggttttg

SEQ ID NO: 403 - protein, 764 aa, Homo sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMGYKFLRIVVWFVSLLALLGNVFVLLILLTSHYKLNVPRFLMCNLAFADFCMGMYLLLIASVDLYTHSEYYNHAIDWQTGPGCNTAGFFTVFASELSVYTLTVITLERWYAITFAMRLDRKIRLRHACAIMVGGWVCCFLLALLPLVGISSYAKVSICLPMDTETPLALAYIVFVLTLNIVAFVIVCCCYVKIYITVRNPQYNPGDKDTKIIKRMAVLIFTDFICMAPISFYALSAILNKPLITVSNSKILLVLFYPLNSCANPFLYAIFTKAFQRDVFILLSKFGICKRQAQAYRGQRVPPKNSTDIQVQKVTHEMRQGLHNMEDVYELIEKSHLTPKKQGQISEEYMQTVL

SEQ ID NO: 404 - DNA, 33 bp, Homo sapiens
aaagataccaaaattaagaagaggatggctgtg

SEQ ID NO: 405 - DNA, 33 bp, Homo sapiens
cacagccatcctcttcttaattttggtatcttt

SEQ ID NO: 406 - DNA, 2292 bp, Homo sapiens
atgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaacggctttacttcagtccaaggatatgctttcaatgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacacctggactcttaagaaacttccactttccttgagtttccttcacctcacacgggctgacctttcttacccaagccactgctgtgcctttaagaatcagaagaaaatcagaggaatccttgagtccttgatgtgtaatgagagcagtatgcagagcttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggctacaagttcctgagaattgtggtgtggttcgttagtctgctggctctcctgggcaatgtctttgtcctgcttattctcctcaccagccactacaaactgaacgtcccccgctttctcatgtgcaacctggcctttgcggatttctgcatggggatgtacctgctcctcatcgcctctgtagacctctacactcactctgagtactacaaccatgccatcgactggcagacaggccctgggtgcaacacggctggtttcttcactgtctttgcaagcgagttatcggtgtatacgctgacggtcatcaccctggagcgctggtatgccatcaccttcgccatgcgcctggaccggaagatccgcctcaggcacgcatgtgccatcatggttgggggctgggtttgctgcttccttctcgccctgcttcctttggtgggaataagtagctatgccaaagtcagtatctgcctgcccatggacaccgagacccctcttgctctggcatatattgtttttgttctgacgctcaacatagttgccttcgtcatcgtctgctgctgttatgtgaagatctacatcacagtccgaaatccgcagtacaacccaggggacaaagataccaaaattaagaagaggatggctgtgttgatcttcaccgacttcatatgcatggccccaatctcattctatgctctgtcagcaattctgaacaagcctctcatcactgttagcaactccaaaatcttgctggtactcttctatccacttaactcctgtgccaatccattcctctatgctattttcaccaaggccttccagagggatgtgttcatcctactcagcaagtttggcatctgtaaacgccaggctcaggcataccgggggcagagggttcctccaaagaacagcactgatattcaggttcaaaaggttacccacgagatgaggcagggtctccacaacatggaagatgtctatgaactgattgaaaagtcccatctaaccccaaagaagcaaggccaaatctcagaagagtatatgcaaacggttttg

SEQ ID NO: 407 - protein, 764 aa, Homo sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMGYKFLRIVVWFVSLLALLGNVFVLLILLTSHYKLNVPRFLMCNLAFADFCMGMYLLLIASVDLYTHSEYYNHAIDWQTGPGCNTAGFFTVFASELSVYTLTVITLERWYAITFAMRLDRKIRLRHACAIMVGGWVCCFLLALLPLVGISSYAKVSICLPMDTETPLALAYIVFVLTLNIVAFVIVCCCYVKIYITVRNPQYNPGDKDTKIKKRMAVLIFTDFICMAPISFYALSAILNKPLITVSNSKILLVLFYPLNSCANPFLYAIFTKAFQRDVFILLSKFGICKRQAQAYRGQRVPPKNSTDIQVQKVTHEMRQGLHNMEDVYELIEKSHLTPKKQGQISEEYMQTVL

SEQ ID NO: 408 - DNA, 34 bp, Homo sapiens
ctatccacttaactcgtacgccaatccattcctc

SEQ ID NO: 409 - DNA, 34 bp, Homo sapiens
gaggaatggattggcgtacgagttaagtggatag

SEQ ID NO: 410 - DNA, 2292 bp, Homo sapiens
atgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaacggctttacttcagtccaaggatatgctttcaatgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacacctggactcttaagaaacttccactttccttgagtttccttcacctcacacgggctgacctttcttacccaagccactgctgtgcctttaagaatcagaagaaaatcagaggaatccttgagtccttgatgtgtaatgagagcagtatgcagagcttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggctacaagttcctgagaattgtggtgtggttcgttagtctgctggctctcctgggcaatgtctttgtcctgcttattctcctcaccagccactacaaactgaacgtcccccgctttctcatgtgcaacctggcctttgcggatttctgcatggggatgtacctgctcctcatcgcctctgtagacctctacactcactctgagtactacaaccatgccatcgactggcagacaggccctgggtgcaacacggctggtttcttcactgtctttgcaagcgagttatcggtgtatacgctgacggtcatcaccctggagcgctggtatgccatcaccttcgccatgcgcctggaccggaagatccgcctcaggcacgcatgtgccatcatggttgggggctgggtttgctgcttccttctcgccctgcttcctttggtgggaataagtagctatgccaaagtcagtatctgcctgcccatggacaccgagacccctcttgctctggcatatattgtttttgttctgacgctcaacatagttgccttcgtcatcgtctgctgctgttatgtgaagatctacatcacagtccgaaatccgcagtacaacccaggggacaaagataccaaaattgccaagaggatggctgtgttgatcttcaccgacttcatatgcatggccccaatctcattctatgctctgtcagcaattctgaacaagcctctcatcactgttagcaactccaaaatcttgctggtactcttctatccacttaactcctacgccaatccattcctctatgctattttcaccaaggccttccagagggatgtgttcatcctactcagcaagtttggcatctgtaaacgccaggctcaggcataccgggggcagagggttcctccaaagaacagcactgatattcaggttcaaaaggttacccacgagatgaggcagggtctccacaacatggaagatgtctatgaactgattgaaaagtcccatctaaccccaaagaagcaaggccaaatctcagaagagtatatgcaaacggttttg

SEQ ID NO: 411 - protein, 764 aa, Homo sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMGYKFLRIVVWFVSLLALLGNVFVLLILLTSHYKLNVPRFLMCNLAFADFCMGMYLLLIASVDLYTHSEYYNHAIDWQTGPGCNTAGFFTVFASELSVYTLTVITLERWYAITFAMRLDRKIRLRHACAIMVGGWVCCFLLALLPLVGISSYAKVSICLPMDTETPLALAYIVFVLTLNIVAFVIVCCCYVKIYITVRNPQYNPGDKDTKIAKRMAVLIFTDFICMAPISFYALSAILNKPLITVSNSKILLVLFYPLNSYANPFLYAIFTKAFQRDVFILLSKFGICKRQAQAYRGQRVPPKNSTDIQVQKVTHEMRQGLHNMEDVYELIEKSHLTPKKQGQISEEYMQTVL

SEQ ID NO: 412 - DNA, 44 bp, Homo sapiens
acccaggggacaaaggtaccaaaattaagaagaggatggctgtg

SEQ ID NO: 413 - DNA, 44 bp, Homo sapiens
cacagccatcctcttcttaattttggtacctttgtcccctgggt

SEQ ID NO: 414 - DNA, 2292 bp, Homo sapiens
atgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaacggctttacttcagtccaaggatatgctttcaatgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacacctggactcttaagaaacttccactttccttgagtttccttcacctcacacgggctgacctttcttacccaagccactgctgtgcctttaagaatcagaagaaaatcagaggaatccttgagtccttgatgtgtaatgagagcagtatgcagagcttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggctacaagttcctgagaattgtggtgtggttcgttagtctgctggctctcctgggcaatgtctttgtcctgcttattctcctcaccagccactacaaactgaacgtcccccgctttctcatgtgcaacctggcctttgcggatttctgcatggggatgtacctgctcctcatcgcctctgtagacctctacactcactctgagtactacaaccatgccatcgactggcagacaggccctgggtgcaacacggctggtttcttcactgtctttgcaagcgagttatcggtgtatacgctgacggtcatcaccctggagcgctggtatgccatcaccttcgccatgcgcctggaccggaagatccgcctcaggcacgcatgtgccatcatggttgggggctgggtttgctgcttccttctcgccctgcttcctttggtgggaataagtagctatgccaaagtcagtatctgcctgcccatggacaccgagacccctcttgctctggcatatattgtttttgttctgacgctcaacatagttgccttcgtcatcgtctgctgctgttatgtgaagatctacatcacagtccgaaatccgcagtacaacccaggggacaaaggtaccaaaattaagaagaggatggctgtgttgatcttcaccgacttcatatgcatggccccaatctcattctatgctctgtcagcaattctgaacaagcctctcatcactgttagcaactccaaaatcttgctggtactcttctatccacttaactcctgtgccaatccattcctctatgctattttcaccaaggccttccagagggatgtgttcatcctactcagcaagtttggcatctgtaaacgccaggctcaggcataccgggggcagagggttcctccaaagaacagcactgatattcaggttcaaaaggttacccacgagatgaggcagggtctccacaacatggaagatgtctatgaactgattgaaaagtcccatctaaccccaaagaagcaaggccaaatctcagaagagtatatgcaaacggttttg

SEQ ID NO: 415 - protein, 764 aa, Homo sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMGYKFLRIVVWFVSLLALLGNVFVLLILLTSHYKLNVPRFLMCNLAFADFCMGMYLLLIASVDLYTHSEYYNHAIDWQTGPGCNTAGFFTVFASELSVYTLTVITLERWYAITFAMRLDRKIRLRHACAIMVGGWVCCFLLALLPLVGISSYAKVSICLPMDTETPLALAYIVFVLTLNIVAFVIVCCCYVKIYITVRNPQYNPGDKGTKIKKRMAVLIFTDFICMAPISFYALSAILNKPLITVSNSKILLVLFYPLNSCANPFLYAIFTKAFQRDVFILLSKFGICKRQAQAYRGQRVPPKNSTDIQVQKVTHEMRQGLHNMEDVYELIEKSHLTPKKQGQISEEYMQTVL

SEQ ID NO: 416 - DNA, 32 bp, Homo sapiens; identical to SEQ ID NO: 392

SEQ ID NO: 417 - DNA, 34 bp, Homo sapiens; identical to SEQ ID NO: 409

SEQ ID NO: 418 - DNA, 2292 bp, Homo sapiens
atgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaacggctttacttcagtccaaggatatgctttcaatgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacacctggactcttaagaaacttccactttccttgagtttccttcacctcacacgggctgacctttcttacccaagccactgctgtgcctttaagaatcagaagaaaatcagaggaatccttgagtccttgatgtgtaatgagagcagtatgcagagcttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggctacaagttcctgagaattgtggtgtggttcgttagtctgctggctctcctgggcaatgtctttgtcctgcttattctcctcaccagccactacaaactgaacgtcccccgctttctcatgtgcaacctggcctttgcggatttctgcatggggatgtacctgctcctcatcgcctctgtagacctctacactcactctgagtactacaaccatgccatcgactggcagacaggccctgggtgcaacacggctggtttcttcactgtctttgcaagcgagttatcggtgcatacgctgacggtcatcaccctggagcgctggtatgccatcaccttcgccatgcgcctggaccggaagatccgcctcaggcacgcatgtgccatcatggttgggggctgggtttgctgcttccttctcgccctgcttcctttggtgggaataagtagctatgccaaagtcagtatctgcctgcccatggacaccgagacccctcttgctctggcatatattgtttttgttctgacgctcaacatagttgccttcgtcatcgtctgctgctgttatgtgaagatctacatcacagtccgaaatccgcagtacaacccaggggacaaagataccaaaattgccaagaggatggctgtgttgatcttcaccgacttcatatgcatggccccaatctcattctatgctctgtcagcaattctgaacaagcctctcatcactgttagcaactccaaaatcttgctggtactcttctatccacttaactcctacgccaatccattcctctatgctattttcaccaaggccttccagagggatgtgttcatcctactcagcaagtttggcatctgtaaacgccaggctcaggcataccgggggcagagggttcctccaaagaacagcactgatattcaggttcaaaaggttacccacgagatgaggcagggtctccacaacatggaagatgtctatgaactgattgaaaagtcccatctaaccccaaagaagcaaggccaaatctcagaagagtatatgcaaacggttttg

SEQ ID NO: 419 - protein, 764 aa, Homo sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMGYKFLRIVVWFVSLLALLGNVFVLLILLTSHYKLNVPRFLMCNLAFADFCMGMYLLLIASVDLYTHSEYYNHAIDWQTGPGCNTAGFFTVFASELSAYTLTVITLERWYAITFAMRLDRKIRLRHACAIMVGGWVCCFLLALLPLVGISSYAKVSICLPMDTETPLALAYIVFVLTLNIVAFVIVCCCYVKIYITVRNPQYNPGDKDTKIAKRMAVLIFTDFICMAPISFYALSAILNKPLITVSNSKILLVLFYPLNSYANPFLYAIFTKAFQRDVFILLSKFGICKRQAQAYRGQRVPPKNSTDIQVQKVTHEMRQGLHNMEDVYELIEKSHLTPKKQGQISEEYMQTVL

SEQ ID NO: 420 - DNA, 33 bp, Homo sapiens; identical to SEQ ID NO: 404

SEQ ID NO: 421 - DNA, 33 bp, Homo sapiens; identical to SEQ ID NO: 405

SEQ ID NO: 422 - DNA, 2292 bp, Homo sapiens
atgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaacggctttacttcagtccaaggatatgctttcaatgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacacctggactcttaagaaacttccactttccttgagtttccttcacctcacacgggctgacctttcttacccaagccactgctgtgcctttaagaatcagaagaaaatcagaggaatccttgagtccttgatgtgtaatgagagcagtatgcagagcttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggctacaagttcctgagaattgtggtgtggttcgttagtctgctggctctcctgggcaatgtctttgtcctgcttattctcctcaccagccactacaaactgaacgtcccccgctttctcatgtgcaacctggcctttgcggatttctgcatggggatgtacctgctcctcatcgcctctgtagacctctacactcactctgagtactacaaccatgccatcgactggcagacaggccctgggtgcaacacggctggtttcttcactgtctttgcaagcgagttatcggtgcatacgctgacggtcatcaccctggagcgctggtatgccatcaccttcgccatgcgcctggaccggaagatccgcctcaggcacgcatgtgccatcatggttgggggctgggtttgctgcttccttctcgccctgcttcctttggtgggaataagtagctatgccaaagtcagtatctgcctgcccatggacaccgagacccctcttgctctggcatatattgtttttgttctgacgctcaacatagttgccttcgtcatcgtctgctgctgttatgtgaagatctacatcacagtccgaaatccgcagtacaacccaggggacaaagataccaaaattaagaagaggatggctgtgttgatcttcaccgacttcatatgcatggccccaatctcattctatgctctgtcagcaattctgaacaagcctctcatcactgttagcaactccaaaatcttgctggtactcttctatccacttaactcctacgccaatccattcctctatgctattttcaccaaggccttccagagggatgtgttcatcctactcagcaagtttggcatctgtaaacgccaggctcaggcataccgggggcagagggttcctccaaagaacagcactgatattcaggttcaaaaggttacccacgagatgaggcagggtctccacaacatggaagatgtctatgaactgattgaaaagtcccatctaaccccaaagaagcaaggccaaatctcagaagagtatatgcaaacggttttg

SEQ ID NO: 423 - protein, 764 aa, Homo sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMGYKFLRIVVWFVSLLALLGNVFVLLILLTSHYKLNVPRFLMCNLAFADFCMGMYLLLIASVDLYTHSEYYNHAIDWQTGPGCNTAGFFTVFASELSAYTLTVITLERWYAITFAMRLDRKIRLRHACAIMVGGWVCCFLLALLPLVGISSYAKVSICLPMDTETPLALAYIVFVLTLNIVAFVIVCCCYVKIYITVRNPQYNPGDKDTKIKKRMAVLIFTDFICMAPISFYALSAILNKPLITVSNSKILLVLFYPLNSYANPFLYAIFTKAFQRDVFILLSKFGICKRQAQAYRGQRVPPKNSTDIQVQKVTHEMRQGLHNMEDVYELIEKSHLTPKKQGQISEEYMQTVL

SEQ ID NO: 424 - DNA, 1266 bp, Homo sapiens
atggatgtgctcagccctggtcagggcaacaacaccacatcaccaccggctccctttgagaccggcggcaacactactggtatctccgacgtgaccgtcagctaccaagtgatcacctctctgctgctgggcacgctcatcttctgcgcggtgctgggcaatgcgtgcgtggtggctgccatcgccttggagcgctccctgcagaacgtggccaattatcttattggctctttggcggtcaccgacctcatggtgtcggtgttggtgctgcccatggccgcgctgtatcaggtgctcaacaagtggacactgggccaggtaacctgcgacctgttcatcgccctcgacgtgctgtgctgcacctcatccatcttgcacctgtgcgccatcgcgctggacaggtactgggccatcacggaccccatcgactacgtgaacaagaggacgccccggccgcgtgcgctcatctcgctcacttggcttattggcttcctcatctctatcccgcccatcctgggctggcgcaccccggaagaccgctcggaccccgacgcatgcaccattagcaaggatcatggctacactatctattccacctttggagctttctacatcccgctgctgctcatgctggttctctatgggcgcatattccgagctgcgcgcttccgcatccgcaagacggtcaaaaaggtggagaagaccggagcggacacccgccatggagcatctcccgccccgcagcccaagaagagtgtgaatggagagtcggggagcaggaactggaggctgggcgtggagagcaaggctgggggtgctctgtgcgccaatggcgcggtgaggcaaggtgacgatggcgccgccctggaggtgatcgaggtgcaccgagtgggcaactccaaagagcacttgcctctgcccagcgaggctggtcctaccccttgtgcccccgcctctttcgagaggaaaaatgagcgcaacgccgaggcgaagcgcaagatggccctggcccgagagaggaagacaaagaagacgctgggcatcatcatgggcaccttcatcctctgctggctgcccttcttcatcgtggctcttgttctgcccttctgcgagagcagctgccacatgcccaccctgttgggcgccataatcaattggctgggctactccaactctctgcttaaccccgtcatttacgcatacttcaacaaggactttcaaaacgcgtttaagaagatcattaagtgtaacttctgccgccagtga

SEQ ID NO: 425 - protein, 421 aa, Homo sapiens
MDVLSPGQGNNTTSPPAPFETGGNTTGISDVTVSYQVITSLLLGTLIFCAVLGNACVVAAIALERSLQNVANYLIGSLAVTDLMVSVLVLPMAALYQVLNKWTLGQVTCDLFIALDVLCCTSSILHLCAIALDRYWAITDPIDYVNKRTPRPRALISLTWLIGFLISIPPILGWRTPEDRSDPDACTISKDHGYTIYSTFGAFYIPLLLMLVLYGRIFRAARFRIRKTVKKVEKTGADTRHGASPAPQPKKSVNGESGSRNWRLGVESKAGGALCANGAVRQGDDGAALEVIEVHRVGNSKEHLPLPSEAGPTPCAPASFERKNERNAEAKRKMALARERKTKKTLGIIMGTFILCWLPFFIVALVLPFCESSCHMPTLLGAIINWLGYSNSLLNPVIYAYFNKDFQNAFKKIIKCNFCRQ

SEQ ID NO: 426 - DNA, 1173 bp, Homo sapiens
atggaggaaccgggtgctcagtgcgctccaccgccgcccgcgggctccgagacctgggttcctcaagccaacttatcctctgctccctcccaaaactgcagcgccaaggactacatttaccaggactccatctccctaccctggaaagtactgctggttatgctattggcgctcatcaccttggccaccacgctctccaatgcctttgtgattgccacagtgtaccggacccggaaactgcacaccccggctaactacctgatcgcctctctggcagtcaccgacctgcttgtgtccatcctggtgatgcccatcagcaccatgtacactgtcaccggccgctggacactgggccaggtggtctgtgacttctggctgtcgtcggacatcacttgttgcactgcctccatcctgcacctctgtgtcatcgccctggaccgctactgggccatcacggacgccgtggagtactcagctaaaaggactcccaagagggcggcggtcatgatcgcgctggtgtgggtcttctccatctctatctcgctgccgcccttcttctggcgtcaggctaaggccgaagaggaggtgtcggaatgcgtggtgaacaccgaccacatcctctacacggtctactccacggtgggtgctttctacttccccaccctgctcctcatcgccctctatggccgcatctacgtagaagcccgctcccggattttgaaacagacgcccaacaggaccggcaagcgcttgacccgagcccagctgataaccgactcccccgggtccacgtcctcggtcacctctattaactcgcgggttcccgacgtgcccagcgaatccggatctcctgtgtatgtgaaccaagtcaaagtgcgagtctccgacgccctgctggaaaagaagaaactcatggccgctagggagcgcaaagccaagaagaccctagggatcattttgggagcctttattgtgtgttggctacccttcttcatcatctccctagtgatgcctatctgcaaagatgcctgctggttccacctagccatctttgacttcttcacatggctgggctatctcaactccctcatcaaccccataatctataccatgtccaatgaggactttaaacaagcattccataaactgatacgttttaagtgcacaagttga

SEQ ID NO: 427 - protein, 390 aa, Homo sapiens
MEEPGAQCAPPPPAGSETWVPQANLSSAPSQNCSAKDYIYQDSISLPWKVLLVMLLALITLATTLSNAFVIATVYRTRKLHTPANYLIASLAVTDLLVSILVMPISTMYTVTGRWTLGQVVCDFWLSSDITCCTASILHLCVIALDRYWAITDAVEYSAKRTPKRAAVMIALVWVFSISISLPPFFWRQAKAEEEVSECVVNTDHILYTVYSTVGAFYFPTLLLIALYGRIYVEARSRILKQTPNRTGKRLTRAQLITDSPGSTSSVTSINSRVPDVPSESGSPVYVNQVKVRVSDALLEKKKLMAARERKAKKTLGIILGAFIVCWLPFFIISLVMPICKDACWFHLAIFDFFTWLGYLNSLINPIIYTMSNEDFKQAFHKLIRFKCTS

SEQ ID NO: 428 - DNA, 1134 bp, Homo sapiens
atgtccccactgaaccagtcagcagaaggccttccccaggaggcctccaacagatccctgaatgccacagaaacctcagaggcttgggatcccaggaccctccaggcgctcaagatctcccttgccgtggtcctttccgtcatcacactggccacagtcctctccaatgcctttgtactcaccaccatcttactcaccaggaagctccacacccctgccaactacctgattggctccctggccaccaccgacctcttggtttccatcttggtaatgcccatcagcatcgcctataccatcacccacacctggaactttggccaaatcttgtgtgacatctggctgtcctctgacatcacgtgctgcacagcctccatcctgcatctctgtgtcattgctctggacaggtactgggcaatcacagatgccctggaatacagtaaacgcaggacggctggccacgcggccaccatgatcgccattgtctgggccatctccatctgcatctccatccccccgctcttctggcggcaggccaaggcccaggaggagatgtcggactgtctggtgaacacctctcagatctcctacaccatctactccacctgtggggccttctacattccctcggtgttgctcatcatcctatatggccggatctaccgggctgcccggaaccgcatcctgaatccaccctcactctatgggaagcgcttcaccacggcccacctcatcacaggctctgccgggtcctcgctctgctcgctcaactccagcctccatgaggggcactcgcactcggctggctcccctctctttttcaaccacgtgaaaatcaagcttgctgacagtgccctggaacgcaagaggatttctgctgctcgagaaaggaaagccaagaaaatcctgggcatcattctgggggcctttatcatctgctggctgcccttcttcgtggtgtctctggtcctccccatctgccgggactcctgctggatccacccggcgctctttgacttcttcacctggctaggctatttaaactccctcatcaatccaataatctacactgtgtttaatgaagagtttcggcaagcttttcagaaaattgtccctttccggaaggcctcctag

SEQ ID NO: 429 - protein, 377 aa, Homo sapiens
MSPLNQSAEGLPQEASNRSLNATETSEAWDPRTLQALKISLAVVLSVITLATVLSNAFVLTTILLTRKLHTPANYLIGSLATTDLLVSILVMPISIAYTITHTWNFGQILCDIWLSSDITCCTASILHLCVIALDRYWAITDALEYSKRRTAGHAATMIAIVWAISICISIPPLFWRQAKAQEEMSDCLVNTSQISYTIYSTCGAFYIPSVLLIILYGRIYRAARNRILNPPSLYGKRFTTAHLITGSAGSSLCSLNSSLHEGHSHSAGSPLFFNHVKIKLADSALERKRISAARERKAKKILGIILGAFIICWLPFFVVSLVLPICRDSCWIHPALFDFFTWLGYLNSLINPIIYTVFNEEFRQAFQKIVPFRKAS

SEQ ID NO: 430 - DNA, 1098 bp, Homo sapiens
atgaacatcacaaactgtaccacagaggccagcatggctataagacccaagaccatcactgagaagatgctcatttgcatgactctggtggtcatcaccaccctcaccacgttgctgaacttggctgtgatcatggctattggcaccaccaagaagctccaccagcctgccaactacctaatctgttctctggccgtgacggacctcctggtggcagtgctcgtcatgcccctgagcatcatctacattgtcatggatcgctggaagcttgggtacttcctctgtgaggtgtggctgagtgtggacatgacctgctgcacctgctccatcctccacctctgtgtcattgccctggacaggtactgggccatcaccaatgctattgaatacgccaggaagaggacggccaagagggccgcgctgatgatccttaccgtctggaccatctccattttcatctccatgccccctctgttctggagaagccaccgccgcctaagccctccccctagtcagtgcaccatccagcacgaccatgttatctacaccatttactccacgctgggtgcgttttatatccccttgactttgatactgattctctattaccggatttaccacgcggccaagagcctttaccagaaaaggggatcaagtcggcacttaagcaacagaagcacagatagccagaattcttttgcaagttgtaaacttacacagactttctgtgtgtctgacttctccacctcagaccctaccacagagtttgaaaagttccatgcctccatcaggatcccccccttcgacaatgatctagatcacccaggagaacgtcagcagatctctagcaccagggaacggaaggcaaaacgcatcctggggctgattctgggtgcattcattttatcctggctgccatttttcatcaaagagttgattgtgggtctgagcatctacaccgtgtcctcggaagtggccgactttctgacgtggctcggttatgtgaattctctgatcaaccctctgctctatacgagttttaatgaagactttaagctggcttttaaaaagctcattagatgccgagagcatacttag

SEQ ID NO: 431 - protein, 365 aa, Homo sapiens
MNITNCTTEASMAIRPKTITEKMLICMTLVVITTLTTLLNLAVIMAIGTTKKLHQPANYLICSLAVTDLLVAVLVMPLSIIYIVMDRWKLGYFLCEVWLSVDMTCCTCSILHLCVIALDRYWAITNAIEYARKRTAKRAALMILTVWTISIFISMPPLFWRSHRRLSPPPSQCTIQHDHVIYTIYSTLGAFYIPLTLILILYYRIYHAAKSLYQKRGSSRHLSNRSTDSQNSFASCKLTQTFCVSDFSTSDPTTEFEKFHASIRIPPFDNDLDHPGERQQISSTRERKAKRILGLILGAFILSWLPFFIKELIVGLSIYTVSSEVADFLTWLGYVNSLINPLLYTSFNEDFKLAFKKLIRCREHT

SEQ ID NO: 432 - DNA, 1101 bp, Homo sapiens
atggatttcttaaattcatctgatcaaaacttgacctcagaggaactgttaaacagaatgccatccaaaattctggtgtccctcactctgtctgggctggcactgatgacaacaactatcaactcccttgtgatcgctgcaattattgtgacccggaagctgcaccatccagccaattatttaatttgttcccttgcagtcacagattttcttgtggctgtcctggtgatgcccttcagcattgtgtatattgtgagagagagctggattatggggcaagtggtctgtgacatttggctgagtgttgacattacctgctgcacgtgctccatcttgcatctctcagctatagctttggatcggtatcgagcaatcacagatgctgttgagtatgccaggaaaaggactccaaagcatgctggcattatgattacaatagtttggattatatctgtttttatctctatgcctcctctattctggaggcaccaaggaactagcagagatgatgaatgcatcatcaagcacgaccacattgtttccaccatttactcaacatttggagctttctacatcccactggcattgattttgatcctttactacaaaatatatagagcagcaaagacattataccacaagagacaagcaagtaggattgcaaaggaggaggtgaatggccaagtccttttggagagtggtgagaaaagcactaaatcagtttccacatcctatgtactagaaaagtctttatctgacccatcaacagactttgataaaattcatagcacagtgagaagtctcaggtctgaattcaagcatgagaaatcttggagaaggcaaaagatctcaggtacaagagaacggaaagcaaagactaccctgggattaatcttgggtgcatttgtaatatgttggcttcctttttttgtaaaagaattagttgttaatgtctgtgacaaatgtaaaatttctgaagaaatgtccaattttttggcatggcttgggtatctcaattcccttataaatccactgatttacacaatctttaatgaagacttcaagaaagcattccaaaagcttgtgcgatgtcgatgttag

SEQ ID NO: 433 - protein, 366 aa, Homo sapiens
MDFLNSSDQNLTSEELLNRMPSKILVSLTLSGLALMTTTINSLVIAAIIVTRKLHHPANYLICSLAVTDFLVAVLVMPFSIVYIVRESWIMGQVVCDIWLSVDITCCTCSILHLSAIALDRYRAITDAVEYARKRTPKHAGIMITIVWIISVFISMPPLFWRHQGTSRDDECIIKHDHIVSTIYSTFGAFYIPLALILILYYKIYRAAKTLYHKRQASRIAKEEVNGQVLLESGEKSTKSVSTSYVLEKSLSDPSTDFDKIHSTVRSLRSEFKHEKSWRRQKISGTRERKAKTTLGLILGAFVICWLPFFVKELVVNVCDKCKISEEMSNFLAWLGYLNSLINPLIYTIFNEDFKKAFQKLVRCRC

SEQ ID NO: 434 - DNA, 1446 bp, Homo sapiens
atggctctctcttacagagtgtctgaacttcaaagcacaattcctgagcacattttgcagagcacctttgttcacgttatctcttctaactggtctggattacagacagaatcaataccagaggaaatgaaacagattgttgaggaacagggaaataaactgcactgggcagctcttctgatactcatggtgataatacccacaattggtggaaatacccttgttattctggctgtttcactggagaagaagctgcagtatgctactaattactttctaatgtccttggcggtggctgatttgctggttggattgtttgtgatgccaattgccctcttgacaataatgtttgaggctatgtggcccctcccacttgttctatgtcctgcctggttatttcttgacgttctcttttcaaccgcatccatcatgcatctctgtgccatttcagtggatcgttacatagccatcaaaaagccaatccaggccaatcaatataactcacgggctacagcattcatcaagattacagtggtgtggttaatttcaataggcattgccattccagtccctattaaagggatagagactgatgtggacaacccaaacaatatcacttgtgtgctgacaaaggaacgttttggcgatttcatgctctttggctcactggctgccttcttcacacctcttgcaattatgattgtcacctactttctcactatccatgctttacagaagaaggcttacttagtcaaaaacaagccacctcaacgcctaacatggttgactgtgtctacagttttccaaagggatgaaacaccttgctcgtcaccggaaaaggtggcaatgctggatggttctcgaaaggacaaggctctgcccaactcaggtgatgaaacacttatgcgaagaacatccacaattgggaaaaagtcagtgcagaccatttccaacgaacagagagccaaaaaggtcctagggattgtgtttttcctctttttgcttatgtggtgtcccttctttattacaaatataactttagttttatgtgattcctgtaaccaaactactctccaaatgctcctggagatatttgtgtggataggctatgtttcctcaggagtgaatcctttggtctacaccctcttcaataagacatttcgggatgcatttggccgatatatcacctgcaattaccgggccacaaagtcagtaaaaactctcagaaaacgctccagtaagatctacttccggaatccaatggcagagaactctaagtttttcaagaaacatggaattcgaaatgggattaaccctgccatgtaccagagtccaatgaggctccgaagttcaaccattcagtcttcatcaatcattctactagatacgcttctcctcactgaaaatgaaggtgacaaaactgaagagcaagttagttatgtatag

SEQ ID NO: 435 - protein, 481 aa, Homo sapiens
MALSYRVSELQSTIPEHILQSTFVHVISSNWSGLQTESIPEEMKQIVEEQGNKLHWAALLILMVIIPTIGGNTLVILAVSLEKKLQYATNYFLMSLAVADLLVGLFVMPIALLTIMFEAMWPLPLVLCPAWLFLDVLFSTASIMHLCAISVDRYIAIKKPIQANQYNSRATAFIKITVVWLISIGIAIPVPIKGIETDVDNPNNITCVLTKERFGDFMLFGSLAAFFTPLAIMIVTYFLTIHALQKKAYLVKNKPPQRLTWLTVSTVFQRDETPCSSPEKVAMLDGSRKDKALPNSGDETLMRRTSTIGKKSVQTISNEQRAKKVLGIVFFLFLLMWCPFFITNITLVLCDSCNQTTLQMLLEIFVWIGYVSSGVNPLVYTLFNKTFRDAFGRYITCNYRATKSVKTLRKRSSKIYFRNPMAENSKFFKKHGIRNGINPAMYQSPMRLRSSTIQSSSIILLDTLLLTENEGDKTEEQVSYV

SEQ ID NO: 436 - protein, 387 aa, Homo sapiens
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAKKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLRYTVLHRGHHQELEKLPIHNDPESLESCF

SEQ ID NO: 437 - DNA, 1164 bp, Homo sapiens
atggacaaacttgatgctaatgtgagttctgaggagggtttcgggtcagtggagaaggtggtgctgctcacgtttctctcgacggttatcctgatggccatcttggggaacctgctggtgatggtggctgtgtgctgggacaggcagctcaggaaaataaaaacaaattatttcattgtatctcttgcttttgcggatctgctggtttcggtgctggtgatgccctttggtgccattgagctggttcaagacatctggatttatggggaggtgttttgtcttgttcggacatctctggacgtcctgctcacaacggcatcgatttttcacctgtgctgcatttctctggataggtattacgccatctgctgccagcctttggtctataggaacaagatgacccctctgcgcatcgcattaatgctgggaggctgctgggtcatccccacgtttatttcttttctccctataatgcaaggctggaataacattggcataattgatttgatagaaaagaggaagttcaaccagaactctaactctacgtactgtgtcttcatggtcaacaagccctacgccatcacctgctctgtggtggccttctacatcccatttctcctcatggtgctggcctattaccgcatctatgtcacagctaaggagcatgcccatcagatccagatgttacaacgggcaggagcctcctccgagagcaggcctcagtcggcagaccagcatagcactcatcgcatgaggacagagaccaaagcaaagaagaccctgtgcatcatcatgggttgcttctgcctctgctgggcaccattctttgtcaccaatattgtggatcctttcatagactacactgtccctgggcaggtgtggactgctttcctctggctcggctatatcaattccgggttgaacccttttctctacgccttcttgaataagtcttttagacgtgccttcctcatcatcctctgctgtgatgatgagcgctaccgaagaccttccattctgggccagactgtcccttgttcaaccacaaccattaatggatccacacatgtactaaggtacaccgttctgcacaggggacatcatcaggaactcgagaaactgcccatacacaatgacccagaatccctggaatcatgcttctga

SEQ ID NO: 438 - DNA, 1167 bp, Homo sapiens
atggacaaacttgatgctaatgtgagttctgaggagggtttcgggtcagtggagaaggtggtgctgctcacgtttctctcgacggttatcctgatggccatcttggggaacctgctggtgatggtggctgtgtgctgggacaggcagctcaggaaaataaaaacaaattatttcattgtatctcttgcttttgcggatctgctggtttcggtgctggtgatgccctttggtgccattgagctggttcaagacatctggatttatggggaggtgttttgtcttgttcggacatctctggacgtcctgctcacaacggcatcgatttttcacctgtgctgcatttctctggataggtattacgccatctgctgccagcctttggtctataggaacaagatgacccctctgcgcatcgcattaatgctgggaggctgctgggtcatccccacgtttatttcttttctccctataatgcaaggctggaataacattggcataattgatttgatagaaaagaggaagttcaaccagaactctaactctacgtactgtgtcttcatggtcaacaagccctacgccatcacctgctctgtggtggccttctacatcccatttctcctcatggtgctggcctattaccgcatctatgtcacagctaaggagcatgcccatcagatccagatgttacaacgggcaggagcctcctccgagagcaggcctcagtcggcagaccagcatagcactcatcgcatgaggacagagaccaaagcaaagaagaccctgtgcatcatcatgggttgcttctgcctctgctgggcaccattctttgtcaccaatattgtggatcctttcatagactacactgtccctgggcaggtgtggactgctttcctctggctcggctatatcaattccgggttgaacccttttctctacgccttcttgaataagtcttttagacgtgccttcctcatcatcctctgctgtgatgatgagcgctaccgaagaccttccattctgggccagactgtcccttgttcaaccacaaccattaatggatccacacatgtactaagggatgcagtggagtgtggtggccagtgggagagtcagtgtcacccgccagcaacttctcctttggtggctgctcagcccagtgacacttag

SEQ ID NO: 439 - protein, 388 aa, Homo sapiens
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAKKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLRDAVECGGQWESQCHPPATSPLVAAQPSDT

SEQ ID NO: 440 - DNA, 1152 bp, Homo sapiens
atggacaaacttgatgctaatgtgagttctgaggagggtttcgggtcagtggagaaggtggtgctgctcacgtttctctcgacggttatcctgatggccatcttggggaacctgctggtgatggtggctgtgtgctgggacaggcagctcaggaaaataaaaacaaattatttcattgtatctcttgcttttgcggatctgctggtttcggtgctggtgatgccctttggtgccattgagctggttcaagacatctggatttatggggaggtgttttgtcttgttcggacatctctggacgtcctgctcacaacggcatcgatttttcacctgtgctgcatttctctggataggtattacgccatctgctgccagcctttggtctataggaacaagatgacccctctgcgcatcgcattaatgctgggaggctgctgggtcatccccacgtttatttcttttctccctataatgcaaggctggaataacattggcataattgatttgatagaaaagaggaagttcaaccagaactctaactctacgtactgtgtcttcatggtcaacaagccctacgccatcacctgctctgtggtggccttctacatcccatttctcctcatggtgctggcctattaccgcatctatgtcacagctaaggagcatgcccatcagatccagatgttacaacgggcaggagcctcctccgagagcaggcctcagtcggcagaccagcatagcactcatcgcatgaggacagagaccaaagcaaagaagaccctgtgcatcatcatgggttgcttctgcctctgctgggcaccattctttgtcaccaatattgtggatcctttcatagactacactgtccctgggcaggtgtggactgctttcctctggctcggctatatcaattccgggttgaacccttttctctacgccttcttgaataagtcttttagacgtgccttcctcatcatcctctgctgtgatgatgagcgctaccgaagaccttccattctgggccagactgtcccttgttcaaccacaaccattaatggatccacacatgtactaagttctggaactgaaaccgacagaagaaactttggaataaggaagagaagattgaccaaaccatcctaatgccaaaaa

SEQ ID NO: 441 - protein, 380 aa, Homo sapiens
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAKKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLSSGTETDRRNFGIRKRRLTKPS

SEQ ID NO: 442 - DNA, 1083 bp, Homo sapiens
atggacaaacttgatgctaatgtgagttctgaggagggtttcgggtcagtggagaaggtggtgctgctcacgtttctctcgacggttatcctgatggccatcttggggaacctgctggtgatggtggctgtgtgctgggacaggcagctcaggaaaataaaaacaaattatttcattgtatctcttgcttttgcggatctgctggtttcggtgctggtgatgccctttggtgccattgagctggttcaagacatctggatttatggggaggtgttttgtcttgttcggacatctctggacgtcctgctcacaacggcatcgatttttcacctgtgctgcatttctctggataggtattacgccatctgctgccagcctttggtctataggaacaagatgacccctctgcgcatcgcattaatgctgggaggctgctgggtcatccccacgtttatttcttttctccctataatgcaaggctggaataacattggcataattgatttgatagaaaagaggaagttcaaccagaactctaactctacgtactgtgtcttcatggtcaacaagccctacgccatcacctgctctgtggtggccttctacatcccatttctcctcatggtgctggcctattaccgcatctatgtcacagctaaggagcatgcccatcagatccagatgttacaacgggcaggagcctcctccgagagcaggcctcagtcggcagaccagcatagcactcatcgcatgaggacagagaccaaagcaaagaagaccctgtgcatcatcatgggttgcttctgcctctgctgggcaccattctttgtcaccaatattgtggatcctttcatagactacactgtccctgggcaggtgtggactgctttcctctggctcggctatatcaattccgggttgaacccttttctctacgccttcttgaataagtcttttagacgtgccttcctcatcatcctctgctgtgatgatgagcgctaccgaagaccttccattctgggccagactgtcccttgttcaaccacaaccattaatggatccacacatgtactaagattttga

SEQ ID NO: 443 - protein, 360 aa, Homo sapiens
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAKKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLRF

SEQ ID NO: 444 - DNA, 1137 bp, Homo sapiens
atggacaaacttgatgctaatgtgagttctgaggagggtttcgggtcagtggagaaggtggtgctgctcacgtttctctcgacggttatcctgatggccatcttggggaacctgctggtgatggtggctgtgtgctgggacaggcagctcaggaaaataaaaacaaattatttcattgtatctcttgcttttgcggatctgctggtttcggtgctggtgatgccctttggtgccattgagctggttcaagacatctggatttatggggaggtgttttgtcttgttcggacatctctggacgtcctgctcacaacggcatcgatttttcacctgtgctgcatttctctggataggtattacgccatctgctgccagcctttggtctataggaacaagatgacccctctgcgcatcgcattaatgctgggaggctgctgggtcatccccacgtttatttcttttctccctataatgcaaggctggaataacattggcataattgatttgatagaaaagaggaagttcaaccagaactctaactctacgtactgtgtcttcatggtcaacaagccctacgccatcacctgctctgtggtggccttctacatcccatttctcctcatggtgctggcctattaccgcatctatgtcacagctaaggagcatgcccatcagatccagatgttacaacgggcaggagcctcctccgagagcaggcctcagtcggcagaccagcatagcactcatcgcatgaggacagagaccaaagcaaagaagaccctgtgcatcatcatgggttgcttctgcctctgctgggcaccattctttgtcaccaatattgtggatcctttcatagactacactgtccctgggcaggtgtggactgctttcctctggctcggctatatcaattccgggttgaacccttttctctacgccttcttgaataagtcttttagacgtgccttcctcatcatcctctgctgtgatgatgagcgctaccgaagaccttccattctgggccagactgtcccttgttcaaccacaaccattaatggatccacacatgtactaagtggctgttcccctgtctccagcttcctcctgctcttctgcaatagaccagttcctgtctaa

SEQ ID NO: 445 - protein, 378 aa, Homo sapiens
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAKKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLSGCSPVSSFLLLFCNRPVPV

SEQ ID NO: 446 - DNA, 1074 bp, Homo sapiens
atggatttaccagtgaacctaacctccttttccctctccaccccctcccctttggagaccaaccacagcctcggcaaagacgacctgcgccccagctcgcccctgctctcggtcttcggagtgcttattctcaccttgctgggctttctggtggcggcgacgttcgcctggaacctgctggtgctggcgaccatcctccgtgtacgcaccttccaccgcgtgccccacaacctggtggcatccatggccgtctcggatgtcctggtggccgcgctggtcatgccgctgagcctggtgcatgagctgtccgggcgccgctggcagctaggtcggaggctgtgccagctttggatcgcgtgcgacgtgctttgctgcacggccagcatctggaacgtgacggccatagccctggaccgctactggtccatcacgcgccacatggaatacacgctccgcacccgcaagtgcgtctccaacgtcatgatcgcgctcacctgggcactctccgctgtcatctctctggccccgctgctttttggctggggagagacgtactctgagggcagcgaggagtgccaggtaagccgcgagccttcctacgccgtgttctccaccgtaggcgccttctacctgccgctctgtgtggtgctcttcgtgtactggaagatctacaaggctgccaagttccgcgtgggctccaggaagaccaatagcgtctcacccatatccgaagctgtggaggtgaaggactctgccaaacagccccagatggtgttcacggtccgccacgccaccgtcaccttccagccagaaggggacacgtggcgggagcagaaggagcagcgggccaagctcatggtgggcatcctcattggcgtgttcgtgctctgctggatccccttctttctcaccgagctcatcagtcccctctgctcctgtgacatccccgccatctggaaaagcatcttcctgtggcttggctactccaactccttctttaaccccctgatctatacggctttcaacaagaactacaacagcgccttcaagaacttcttttctaggcaacactga

SEQ ID NO: 447 - protein, 357 aa, Homo sapiens
MDLPVNLTSFSLSTPSPLETNHSLGKDDLRPSSPLLSVFGVLILTLLGFLVAATFAWNLLVLATILRVRTFHRVPHNLVASMAVSDVLVAALVMPLSLVHELSGRRWQLGRRLCQLWIACDVLCCTASIWNVTAIALDRYWSITRHMEYTLRTRKCVSNVMIALTWALSAVISLAPLLFGWGETYSEGSEECQVSREPSYAVFSTVGAFYLPLCVVLFVYWKIYKAAKFRVGSRKTNSVSPISEAVEVKDSAKQPQMVFTVRHATVTFQPEGDTWREQKEQRAKLMVGILIGVFVLCWIPFFLTELISPLCSCDIPAIWKSIFLWLGYSNSFFNPLIYTAFNKNYNSAFKNFFSRQH

SEQ ID NO: 448 - DNA, 1323 bp, Homo sapiens
atggtcccagagccgggcccaaccgccaatagcaccccggcctggggggcagggccgccgtcggccccggggggcagcggctgggtggcggccgcgctgtgcgtggtcatcgcgctgacggcggcggccaactcgctgctgatcgcgctcatctgcactcagcccgcgctgcgcaacacgtccaacttcttcctggtgtcgctcttcacgtctgacctgatggtggggctggtggtgatgccgccggccatgctgaacgcgctgtacgggcgctgggtgctggcgcgcggcctctgcctgctctggaccgccttcgacgtgatgtgctgcagcgcctccatcctcaacctctgcctcatcagcctggaccgctacctgctcatcctctcgccgctgcgctacaagctgcgcatgacgcccctgcgtgccctggccctagtcctgggcgcctggagcctcgccgctctcgcctccttcctgcccctgctgctgggctggcacgagctgggccacgcacggccacccgtccctggccagtgccgcctgctggccagcctgccttttgtccttgtggcgtcgggcctcaccttcttcctgccctcgggtgccatatgcttcacctactgcaggatcctgctagctgcccgcaagcaggccgtgcaggtggcctccctcaccaccggcatggccagtcaggcctcggagacgctgcaggtgcccaggaccccacgcccaggggtggagtctgctgacagcaggcgtctagccacgaagcacagcaggaaggccctgaaggccaagctgacgctgggcatcctgctgggcatgttctttgtgacctggttgcccttctttgtggccaacatagtccaggccgtgtgcgactgcatctccccaggcctcttcgatgtcctcacatggctgggttactgtaacagcaccatgaaccccatcatctacccactcttcatgcgggacttcaagcgggcgctgggcaggttcctgccatgtccacgctgtccccgggagcgccaggccagcctggcctcgccatcactgcgcacctctcacagcggcccccggcccggccttagcctacagcaggtgctgccgctgcccctgccgccggactcagattcggactcagacgcaggctcaggcggctcctcgggcctgcggctcacggcccagctgctgcttcctggcgaggccacccaggaccccccgctgcccaccagggccgctgccgccgtcaatttcttcaacatcgaccccgcggagcccgagctgcggccgcatccacttggcatccccacgaactga

SEQ ID NO: 449 - protein, 440 aa, Homo sapiens
MVPEPGPTANSTPAWGAGPPSAPGGSGWVAAALCVVIALTAAANSLLIALICTQPALRNTSNFFLVSLFTSDLMVGLVVMPPAMLNALYGRWVLARGLCLLWTAFDVMCCSASILNLCLISLDRYLLILSPLRYKLRMTPLRALALVLGAWSLAALASFLPLLLGWHELGHARPPVPGQCRLLASLPFVLVASGLTFFLPSGAICFTYCRILLAARKQAVQVASLTTGMASQASETLQVPRTPRPGVESADSRRLATKHSRKALKAKLTLGILLGMFFVTWLPFFVANIVQAVCDCISPGLFDVLTWLGYCNSTMNPIIYPLFMRDFKRALGRFLPCPRCPRERQASLASPSLRTSHSGPRPGLSLQQVLPLPLPPDSDSDSDAGSGGSSGLRLTAQLLLPGEATQDPPLPTRAAAAVNFFNIDPAEPELRPHPLGIPTN

SEQ ID NO: 450 - DNA, 1379 bp, Homo sapiens
atgatggacgttaacagcagcggccgcccggacctctacgggcacctccgctctttccttctgccagaagtggggcgcgggctgcccgacttgagccccgacggtggcgccgacccggtcgcgggctcctgggcgccgcacctgctgagcgaggtgacagccagcccggcgcccacctgggacgcgcccccggacaatgcctccggctgtggggaacagatcaactacggcagagtcgagaaagttgtgatcggctccatcctgacgctcatcacgctgctgacgatcgcgggcaactgcctggtggtgatctccgtgtgcttcgtcaagaagctccgccagccctccaactacctgatcgtgtccctggcgctggccgacctctcggtggctgtggcggtcatgcccttcgtcagcgtcaccgacctcatcgggggcaagtggatctttggacactttttctgtaatgtcttcatcgccatggacgtcatgtgctgcacggcctcgatcatgaccctgtgcgtgatcagcattgacaggtaccttgggatcacaaggcccctcacataccctgtgaggcagaatgggaaatgcatggcgaagatgattctctccgtctggcttctctccgcctccatcaccttacctccactctttggatgggctcagaatgtaaatgatgataaggtgtgcttgatcagccaggactttggctatacgatttactctaccgcagtggcattttatatccccatgtccgtcatgcttttcatgtactaccagatttacaaggctgccaggaagagtgctgccaaacacaagtttcctggcttccctcgagtggagccagacagcgtcatcgccctgaatggcatagtgaagctccagaaggaggtggaagagtgtgcaaacctttcgagactcctcaagcatgaaaggaaaaacatctccatctttaagcgagaacagaaagcaaagaccaccctggggatcatcgtcggggcctttaccgtgtgctggctgccatttttcctcctctcgacagccagacccttcatctgtggcacttcctgcagctgcatcccactgtgggtggagaggacatttctgtggctaggctatgcaaactctctcattaacccttttatatatgccttcttcaaccgggacctgaggaccacctatcgcagcctgctccagtgccagtaccggaatatcaaccggaagctctcagctgcaggcatgcatgaagccctgaagcttgctgagaggccagagagacctgagtttgtgctacaaaatgctgactactgtagaaaaaaaggtcatgattcatgattgaaagcagaacaatggagaggaattcgatatcaagctta

SEQ ID NO: 451 - protein, 445 aa, Homo sapiens
MMDVNSSGRPDLYGHLRSFLLPEVGRGLPDLSPDGGADPVAGSWAPHLLSEVTASPAPTWDAPPDNASGCGEQINYGRVEKVVIGSILTLITLLTIAGNCLVVISVCFVKKLRQPSNYLIVSLALADLSVAVAVMPFVSVTDLIGGKWIFGHFFCNVFIAMDVMCCTASIMTLCVISIDRYLGITRPLTYPVRQNGKCMAKMILSVWLLSASITLPPLFGWAQNVNDDKVCLISQDFGYTIYSTAVAFYIPMSVMLFMYYQIYKAARKSAAKHKFPGFPRVEPDSVIALNGIVKLQKEVEECANLSRLLKHERKNISIFKREQKAKTTLGIIVGAFTVCWLPFFLLSTARPFICGTSCSCIPLWVERTFLWLGYANSLINPFIYAFFNRDLRTTYRSLLQCQYRNINRKLSAAGMHEALKLAERPERPEFVLQNADYCRKKGHDS

SEQ ID NO: 452 - DNA, 1257 bp, Homo sapiens
atgcgtctctccgccggtcccgacgcggggccctcgggcaactccagcccatggtggcctctggccaccggcgctggcaacacaagccgggaggccgaagccctcggggagggcaacggcccaccgagggacgtgcgcaacgaggagctggccaaactggagatcgccgtgctggcggtgactttcgcggtggccgtgctgggcaacagcagcgtactgctggctctgcaccggacgccgcgcaagacgtcccgcatgcacctcttcatccgacacctcagcctggccgacctggccgtggcattcttccaggtgctgccgcaaatgtgctgggacatcacctaccgcttccgcggccccgactggctgtgccgcgtggtgaagcacctgcaggtgttcggcatgtttgcgtcggcctacatgctggtagtcatgacagccgaccgctacatcgcggtgtgccacccgctcaagactctgcaacagcccgcgcgccgctcgcgcctcatgatcgcggccgcctgggtgctgagcttcgtgctgagcacgccgcagtacttcgtcttctccatgatcgaggtgaacaatgtcaccaaggcccgcgactgctgggccaccttcatccagccctggggttctcgtgcctacgtgacctggatgacgggcggcatctttgtggcgcccgtggtcatcttgggtacctgctacggcttcatctgctacaacatctggtgcaacgtccgcgggaagacggcgtcgcgccagagcaagggtgcagagcaagcgggtgtggccttccaaaaggggttcctgctcgcaccctgtgtcagcagcgtgaagtccatttcccgggccaagatccgcacgaagaagatgacttttgtgatcgtgacggcttacatcgtctgctgggcgcctttcttcatcatccagatgtggtctgtctgggatcccatgtccgtctggaccgaatcggaaaaccctaccatcaccatcactgcattactgggttccttgaatagctgctgtaatccctggatatacatgttttttagtggccatctccttcaagactgtgttcaaagcttcccatgctgccaaaacatgaaggaaaaattcaacaaagaagatactgacagtatgagcagaagacagactttttattctaacaatcgaagcccaacaaacagtacgggtatgtggaaggactcgcctaaatcttccaagtccatcaaattcattcctgtttcaacttga

SEQ ID NO: 453 - protein, 418 aa, Homo sapiens
MRLSAGPDAGPSGNSSPWWPLATGAGNTSREAEALGEGNGPPRDVRNEELAKLEIAVLAVTFAVAVLGNSSVLLALHRTPRKTSRMHLFIRHLSLADLAVAFFQVLPQMCWDITYRFRGPDWLCRVVKHLQVFGMFASAYMLVVMTADRYIAVCHPLKTLQQPARRSRLMIAAAWVLSFVLSTPQYFVFSMIEVNNVTKARDCWATFIQPWGSRAYVTWMTGGIFVAPVVILGTCYGFICYNIWCNVRGKTASRQSKGAEQAGVAFQKGFLLAPCVSSVKSISRAKIRTKKMTFVIVTAYIVCWAPFFIIQMWSVWDPMSVWTESENPTITITALLGSLNSCCNPWIYMFFSGHLLQDCVQSFPCCQNMKEKFNKEDTDSMSRRQTFYSNNRSPTNSTGMWKDSPKSSKSIKFIPVST

SEQ ID NO: 454 - DNA, 1275 bp, Homo sapiens
atggattctgggcctctgtgggatgccaaccccacccctcggggcaccctctctgcccccaatgccacaacaccctggctgggccgggatgaggagctggccaaggtggagatcggagtcctggccactgtcctggtgctggcgaccgggggcaacctggctgtgctgctgaccctgggccagctgggccgcaagcgctcccgcatgcacctgttcgtgctgcacttagccctgacagacctggccgtggcgctcttccaggtgctgccacagctgctgtgggacatcacctaccgcttccagggccccgacctcctgtgcagggccgtcaagtacctgcaggtgctcagcatgtttgcctccacctacatgctgctggccatgacgctggaccgctacctggctgtctgtcaccccctgcgcagcctccagcagccaggccagtccacctacctgctcatcgctgctccctggctgctggccgccatcttcagcctccctcaagtcttcattttttccctgcgggaggtgatccagggctcaggggtgctggactgctgggcagacttcggcttcccttgggggccacgggcctacctcacctggaccaccctggctatcttcgttctgccggtgaccatgctcacggcctgctacagcctcatctgccatgagatctgtaaaaacctaaaagtcaagacacaggcctggcgggtgggaggagggggctggaggacttgggacaggccctcaccttccaccttagctgccaccactcgggggctgccatctcgggtcagcagcatcaacaccatctcacgggccaagatccgaacaaagaagatgacctttgtcatcgtgctggcctacatcgcttgctgggctcccttcttcagtgtccagatgtggtccgtgtgggacaagaatgcccctgatgaagattccaccaatgtggctttcaccatctctatgcttttgggcaacctcaacagctgctgcaacccctggatctacatgggcttcaacagccacctgttaccgcggcccctgcgtcaccttgcctgctgtgggggtccccagcccaggatgcgccggcggctctccgacggcagcctctcgagccgccacaccacgctgctgacccgctccagctgcccggccaccctcagcctcagcctcagcctaaccctcagtgggaggcccaggcctgaagagtcaccaagggacttggagctggcagatggggaaggcaccgctgagaccatcatcttttag

SEQ ID NO: 455 - protein, 424 aa, Homo sapiens
MDSGPLWDANPTPRGTLSAPNATTPWLGRDEELAKVEIGVLATVLVLATGGNLAVLLTLGQLGRKRSRMHLFVLHLALTDLAVALFQVLPQLLWDITYRFQGPDLLCRAVKYLQVLSMFASTYMLLAMTLDRYLAVCHPLRSLQQPGQSTYLLIAAPWLLAAIFSLPQVFIFSLREVIQGSGVLDCWADFGFPWGPRAYLTWTTLAIFVLPVTMLTACYSLICHEICKNLKVKTQAWRVGGGGWRTWDRPSPSTLAATTRGLPSRVSSINTISRAKIRTKKMTFVIVLAYIACWAPFFSVQMWSVWDKNAPDEDSTNVAFTISMLLGNLNSCCNPWIYMGFNSHLLPRPLRHLACCGGPQPRMRRRLSDGSLSSRHTTLLTRSSCPATLSLSLSLTLSGRPRPEESPRDLELADGEGTAETIIF

SEQ ID NO: 456 - DNA, 1116 bp, Homo sapiens
atgctcatggcgtccaccacttccgctgtgcctgggcatccctctctgcccagcctgcccagcaacagcagccaggagaggccactggacacccgggacccgctgctagcccgggcggagctggcgctgctctccatagtctttgtggctgtggccctgagcaatggcctggtgctggcggccctagctcggcggggccggcggggccactgggcacccatacacgtcttcattggccacttgtgcctggccgacctggccgtggctctgttccaagtgctgccccagctggcctggaaggccaccgaccgcttccgtgggccagatgccctgtgtcgggccgtgaagtatctgcagatggtgggcatgtatgcctcctcctacatgatcctggccatgacgctggaccgccaccgtgccatctgccgtcccatgctggcgtaccgccatggaagtggggctcactggaaccggccggtgctagtggcttgggccttctcgctccttctcagcctgccccagctcttcatcttcgcccagcgcaacgtggaaggtggcagcggggtcactgactgctgggcctgctttgcggagccctggggccgtcgcacctatgtcacctggattgccctgatggtgttcgtggcacctaccctgggtatcgccgcctgccaggtgctcatcttccgggagattcatgccagtctggtgccagggccatcagagaggcctggggggcgccgcaggggacgccggacaggcagccccggtgagggagcccacgtgtcagcagctgtggccaagactaagaggatgacgctagtgattgtggtcgtctatgtgctgtgctgggcacccttcttcctggtgcagctgtgggccgcgtgggacccggaggcacctctggaaggggcgccctttgtgctactcatgttgctggccagcctcaacagctgcaccaacccctggatctatgcatctttcagcagcagcgtgtcctcagagctgcgaagcttgctctgctgtgcccggggacgcaccccacccagcctgggtccccaagatgagtcctgcaccaccgccagctcctccctggccaaggacacttcatcgtga

SEQ ID NO: 457 - protein, 371 aa, Homo sapiens
MLMASTTSAVPGHPSLPSLPSNSSQERPLDTRDPLLARAELALLSIVFVAVALSNGLVLAALARRGRRGHWAPIHVFIGHLCLADLAVALFQVLPQLAWKATDRFRGPDALCRAVKYLQMVGMYASSYMILAMTLDRHRAICRPMLAYRHGSGAHWNRPVLVAWAFSLLLSLPQLFIFAQRNVEGGSGVTDCWACFAEPWGRRTYVTWIALMVFVAPTLGIAACQVLIFREIHASLVPGPSERPGGRRRGRRTGSPGEGAHVSAAVAKTKRMTLVIVVVYVLCWAPFFLVQLWAAWDPEAPLEGAPFVLLMLLASLNSCTNPWIYASFSSSVSSELRSLLCCARGRTPPSLGPQDESCTTASSSLAKDTSS

SEQ ID NO: 458 - DNA, 1200 bp, Homo sapiens
atggctcaaaggcagcctcactcacctaatcagactttaatttcaatcacaaatgacacagaatcatcaagctctgtggtttctaacgataacacaaataaaggatggagcggggacaactctccaggaatagaagcattgtgtgccatctatattacttatgctgtgatcatttcagtgggcatccttggaaatgctattctcatcaaagtctttttcaagaccaaatccatgcaaacagttccaaatattttcatcaccagcctggcttttggagatcttttacttctgctaacttgtgtgccagtggatgcaactcactaccttgcagaaggatggctgttcggaagaattggttgtaaggtgctctctttcatccggctcacttctgttggtgtgtcagtgttcacattaacaattctcagcgctgacagatacaaggcagttgtgaagccacttgagcgacagccctccaatgccatcctgaagacttgtgtaaaagctggctgcgtctggatcgtgtctatgatatttgctctacctgaggctatattttcaaatgtatacacttttcgagatcccaataaaaatatgacatttgaatcatgtacctcttatcctgtctctaagaagctcttgcaagaaatacattctctgctgtgcttcttagtgttctacattattccactctctattatctctgtctactattccttgattgctaggaccctttacaaaagcaccctgaacatacctactgaggaacaaagccatgcccgtaagcagattgaatcccgaaagagaattaaaagaacggtattggtgttggtggctctgtttgccctctgctggttgccaaatcacctcctgtacctctaccattcattcacttctcaaacctatgtagacccctctgccatgcatttcattttcaccattttctctcgggttttggctttcagcaattcttgcgtaaacccctttgctctctactggctgagcaaaagcttccagaagcattttaaagctcagttgttctgttgcaaggcggagcggcctgagcctcctgttgctgacacctctcttaccaccctggctgtgatgggaacggtcccgggcactgggagcatacagatgtctgaaattagtgtgacctcgttcactgggtgtagtgtgaagcaggcagaggacagattctag

SEQ ID NO: 459 - protein, 399 aa, Homo sapiens
MAQRQPHSPNQTLISITNDTESSSSVVSNDNTNKGWSGDNSPGIEALCAIYITYAVIISVGILGNAILIKVFFKTKSMQTVPNIFITSLAFGDLLLLLTCVPVDATHYLAEGWLFGRIGCKVLSFIRLTSVGVSVFTLTILSADRYKAVVKPLERQPSNAILKTCVKAGCVWIVSMIFALPEAIFSNVYTFRDPNKNMTFESCTSYPVSKKLLQEIHSLLCFLVFYIIPLSIISVYYSLIARTLYKSTLNIPTEEQSHARKQIESRKRIKRTVLVLVALFALCWLPNHLLYLYHSFTSQTYVDPSAMHFIFTIFSRVLAFSNSCVNPFALYWLSKSFQKHFKAQLFCCKAERPEPPVADTSLTTLAVMGTVPGTGSIQMSEISVTSFTGCSVKQAEDRF

SEQ ID NO: 460 - DNA, 1062 bp, Homo sapiens
atggcatcatcctggccccctctagagctccaatcctccaaccagagccagctcttccctcaaaatgctacggcctgtgacaatgctccagaagcctgggacctgctgcacagagtgctgccgacatttatcatctccatctgtttcttcggcctcctagggaacctttttgtcctgttggtcttcctcctgccccggcggcaactgaacgtggcagaaatctacctggccaacctggcagcctctgatctggtgtttgtcttgggcttgcccttctgggcagagaatatctggaaccagtttaactggcctttcggagccctcctctgccgtgtcatcaacggggtcatcaaggccaatttgttcatcagcatcttcctggtggtggccatcagccaggaccgctaccgcgtgctggtgcaccctatggccagccggaggcagcagcggcggaggcaggcccgggtcacctgcgtgctcatctgggttgtggggggcctcttgagcatccccacattcctgctgcgatccatccaagccgtcccagatctgaacatcaccgcctgcatcctgctcctcccccatgaggcctggcactttgcaaggattgtggagttaaatattctgggtttcctcctaccactggctgcgatcgtcttcttcaactaccacatcctggcctccctgcgaacgcgggaggaggtcagcaggacaaggtgcgggggccgcaaggatagcaagaccaaagcgctgatcctcacgctcgtggttgccttcctggtctgctgggccccttaccacttctttgccttcctggaattcttattccaggtgcaagcagtccgaggctgcttttgggaggacttcattgacctgggcctgcaattggccaacttctttgccttcactaacagctccctgaatccagtaatttatgtctttgtgggccggctcttcaggaccaaggtctgggaactttataaacaatgcacccctaaaagtcttgctccaatatcttcatcccataggaaagaaatcttccaacttttctggcggaattaa

SEQ ID NO: 461 - protein, 353 aa, Homo sapiens
MASSWPPLELQSSNQSQLFPQNATACDNAPEAWDLLHRVLPTFIISICFFGLLGNLFVLLVFLLPRRQLNVAEIYLANLAASDLVFVLGLPFWAENIWNQFNWPFGALLCRVINGVIKANLFISIFLVVAISQDRYRVLVHPMASRRQQRRRQARVTCVLIWVVGGLLSIPTFLLRSIQAVPDLNITACILLLPHEAWHFARIVELNILGFLLPLAAIVFFNYHILASLRTREEVSRTRCGGRKDSKTKALILTLVVAFLVCWAPYHFFAFLEFLFQVQAVRGCFWEDFIDLGLQLANFFAFTNSSLNPVIYVFVGRLFRTKVWELYKQCTPKSLAPISSSHRKEIFQLFWRN

SEQ ID NO: 462 - DNA, 1176 bp, Homo sapiens
atgttctctccctggaagatatcaatgtttctgtctgttcgtgaggactccgtgcccaccacggcctctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccaaggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtga

SEQ ID NO: 463 - protein, 391 aa, Homo sapiens
MFSPWKISMFLSVREDSVPTTASFSADMLNVTLQGPTLNGTFAQSKCPQVEWLGWLNTIQPPFLWVLFVLATLENIFVLSVFCLHKSSCTVAEIYLGNLAAADLILACGLPFWAITISNNFDWLFGETLCRVVNAIISMNLYSSICFLMLVSIDRYLALVKTMSMGRMRGVRWAKLYSLVIWGCTLLLSSPMLVFRTMKEYSDEGHNVTACVISYPSLIWEVFTNMLLNVVGFLLPLSVITFCTMQIMQVLRNNEMQKFKEIQTERRAKVLVLVVLLLFIICWLPFQISTFLDTLHRLGILSSCQDERIIDVITQIASFMAYSNSCLNPLVYVIVGKRFRKKSWEVYQGVCQKGGCRSEPIQMENSMGTLRTSISVERQIHKLQDWAGSRQ

SEQ ID NO: 464 - DNA, 1449 bp, Homo sapiens
atggcgtctttctctgctgagaccaattcaactgacctactctcacagccatggaatgagcccccagtaattctctccatggtcattctcagccttacttttttactgggattgccaggcaatgggctggtgctgtgggtggctggcctgaagatgcagcggacagtgaacacaatttggttcctccacctcaccttggcggacctcctctgctgcctctccttgcccttctcgctggctcacttggctctccagggacagtggccctacggcaggttcctatgcaagctcatcccctccatcattgtcctcaacatgtttgccagtgtcttcctgcttactgccattagcctggatcgctgtcttgtggtattcaagccaatctggtgtcagaatcatcgcaatgtagggatggcctgctctatctgtggatgtatctgggtggtggcttgtgtgatgtgcattcctgtgttcgtgtaccgggaaatcttcactacagacaaccataatagatgtggctacaaatttggtctctccagctcattagattatccagacttttatggagatccactagaaaacaggtctcttgaaaacattgttcagccgcctggagaaatgaatgataggttagatccttcctctttccaaacaaatgatcatccttggacagtccccactgtcttccaacctcaaacatttcaaagaccttctgcagattcactccctaggggttctgctaggttaacaagtcaaaatctgtattctaatgtatttaaacctgctgatgtggtctcacctaaaatccccagtgggtttcctattgaagatcacgaaaccagcccactggataactctgatgcttttctctctactcatttaaagctgttccctagcgcttctagcaattccttctacgagtctgagctaccacaaggtttccaggattattacaatttaggccaattcacagatgacgatcaagtgccaacacccctcgtggcaataacgatcactaggctagtggtgggtttcctgctgccctctgttatcatgatagcctgttacagcttcattgtcttccgaatgcaaaggggccgcttcgccaagtctcagagcaaaaccaagcgagtggccgtggtggtggtggctgtctttcttgtctgctggactccataccacatttttggagtcctgtcattgcttactgacccagaaactcccttggggaaaactctgatgtcctgggatcatgtatgcattgctctagcatctgccaatagttgctttaatcccttcctttatgccctcttggggaaagattttaggaagaaagcaaggcagtccattcagggaattctggaggcagccttcagtgaggagctcacacgttccacccactgtccctcaaacaatgtcatttcagaaagaaatagtacaactgtgtga

SEQ ID NO: 465 - protein, 482 aa, Homo sapiens
MASFSAETNSTDLLSQPWNEPPVILSMVILSLTFLLGLPGNGLVLWVAGLKMQRTVNTIWFLHLTLADLLCCLSLPFSLAHLALQGQWPYGRFLCKLIPSIIVLNMFASVFLLTAISLDRCLVVFKPIWCQNHRNVGMACSICGCIWVVACVMCIPVFVYREIFTTDNHNRCGYKFGLSSSLDYPDFYGDPLENRSLENIVQPPGEMNDRLDPSSFQTNDHPWTVPTVFQPQTFQRPSADSLPRGSARLTSQNLYSNVFKPADVVSPKIPSGFPIEDHETSPLDNSDAFLSTHLKLFPSASSNSFYESELPQGFQDYYNLGQFTDDDQVPTPLVAITITRLVVGFLLPSVIMIACYSFIVFRMQRGRFAKSQSKTKRVAVVVVAVFLVCWTPYHIFGVLSLLTDPETPLGKTLMSWDHVCIALASANSCFNPFLYALLGKDFRKKARQSIQGILEAAFSEELTRSTHCPSNNVISERNSTTV

SEQ ID NO: 466 - DNA, 1053 bp, Homo sapiens
atgaactccttcaattataccacccctgattatgggcactatgatgacaaggataccctggacctcaacacccctgtggataaaacttctaacacgctgcgtgttccagacatcctggccttggtcatctttgcagtcgtcttcctggtgggagtgctgggcaatgccctggtggtctgggtgacggcattcgaggccaagcggaccatcaatgccatctggttcctcaacttggcggtagccgacttcctctcctgcctggcgctgcccatcttgttcacgtccattgtacagcatcaccactggccctttggcggggccgcctgcagcatcctgccctccctcatcctgctcaacatgtacgccagcatcctgctcctggccaccatcagcgccgaccgctttctgctggtgtttaaacccatctggtgccagaacttccgaggggccggcttggcctggatcgcctgtgccgtggcttggggtttagccctgctgctgaccataccctccttcctgtaccgggtggtccgggaggagtactttccaccaaaggtgttgtgtggcgtggactacagccacgacaaacggcgggagcgagccgtggccatcgtccggctggtcctgggcttcctgtggcctctactcacgctcacgatttgttacactttcatcctgctccggacgtggagccgcagggccacgcggtccaccaagacaaagaaggtggtggtggcagtggtggccagtttctttatcttctggttgccctaccaggtgacggggataatgatgtccttcctggagccatcgtcacccaccttcctgctgctgaataagctggactccctgtgtgtctcctttgcctacatcaactgctgcatcaaccccatcatctacgtggtggccggccagggcttccagggccgactgcggaaatccctccccagcctcctccggaacgtgttgactgaagagtccgtggttagggagagcaagtcattcacgcgctccacagtggacactatggcccagaagacccaggcagtgtag

SEQ ID NO: 467 - protein, 350 aa, Homo sapiens
MNSFNYTTPDYGHYDDKDTLDLNTPVDKTSNTLRVPDILALVIFAVVFLVGVLGNALVVWVTAFEAKRTINAIWFLNLAVADFLSCLALPILFTSIVQHHHWPFGGAACSILPSLILLNMYASILLLATISADRFLLVFKPIWCQNFRGAGLAWIACAVAWGLALLLTIPSFLYRVVREEYFPPKVLCGVDYSHDKRRERAVAIVRLVLGFLWPLLTLTICYTFILLRTWSRRATRSTKTKKVVVAVVASFFIFWLPYQVTGIMMSFLEPSSPTFLLLNKLDSLCVSFAYINCCINPIIYVVAGQGFQGRLRKSLPSLLRNVLTEESVVRESKSFTRSTVDTMAQKTQAV

SEQ ID NO: 468 - DNA, 1419 bp, Homo sapiens
atgaagtcgatcctagatggccttgcagataccaccttccgcaccatcaccactgacctcctgtacgtgggctcaaatgacattcagtacgaagacatcaaaggtgacatggcatccaaattagggtacttcccacagaaattccctttaacttcctttaggggaagtcccttccaagagaagatgactgcgggagacaacccccagctagtcccagcagaccaggtgaacattacagaattttacaacaagtctctctcgtccttcaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtagcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttaaagaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtga

SEQ ID NO: 469 - protein, 472 aa, Homo sapiens
MKSILDGLADTTFRTITTDLLYVGSNDIQYEDIKGDMASKLGYFPQKFPLTSFRGSPFQEKMTAGDNPQLVPADQVNITEFYNKSLSSFKENEENIQCGENFMDIECFMVLNPSQQLAIAVLSLTLGTFTVLENLLVLCVILHSRSLRCRPSYHFIGSLAVADLLGSVIFVYSFIDFHVFHRKDSRNVFLFKLGGVTASFTASVGSLFLTAIDRYISIHRPLAYKRIVTRPKAVVAFCLMWTIAIVIAVLPLLGWNCEKLQSVCSDIFPHIDETYLMFWIGVTSVLLLFIVYAYMYILWKAHSHAVRMIQRGTQKSIIIHTSEDGKVQVTRPDQARMDIRLKKTLVLILVVLIICWGPLLAIMVYDVFGKMNKLIKTVFAFCSMLCLLNSTVNPIIYALRSKDLRHAFRSMFPSCEGTAQPLDNSMGDSDCLHKHANNAASVHRAAESCIKSTVKIAKVTMSVSTDTSAEAL

SEQ ID NO: 470 - DNA, 1083 bp, Homo sapiens
atggaggaatgctgggtgacagagatagccaatggctccaaggatggcttggattccaaccctatgaaggattacatgatcctgagtggtccccagaagacagctgttgctgtgttgtgcactcttctgggcctgctaagtgccctggagaacgtggctgtgctctatctgatcctgtcctcccaccaactccgccggaagccctcatacctgttcattggcagcttggctggggctgacttcctggccagtgtggtctttgcatgcagctttgtgaatttccatgttttccatggtgtggattccaaggctgtcttcctgctgaagattggcagcgtgactatgaccttcacagcctctgtgggtagcctcctgctgaccgccattgaccgatacctctgcctgcgctatccaccttcctacaaagctctgctcacccgtggaagggcactggtgaccctgggcatcatgtgggtcctctcagcactagtctcctacctgcccctcatgggatggacttgctgtcccaggccctgctctgagcttttcccactgatccccaatgactacctgctgagctggctcctgttcatcgccttcctcttttccggaatcatctacacctatgggcatgttctctggaaggcccatcagcatgtggccagcttgtctggccaccaggacaggcaggtgccaggaatggcccgaatgaggctggatgtgaggttgaagaagaccctagggctagtgttggctgtgctcctcatctgttggttcccagtgctggccctcatggcccacagcctggccactacgctcagtgaccaggtcaagaaggcctttgctttctgctccatgctgtgcctcatcaactccatggtcaaccctgtcatctatgctctacggagtggagagatccgctcctctgcccatcactgcctggctcactggaagaagtgtgtgaggggccttgggtcagaggcaaaagaagaagccccgagatcctcagtcaccgagacagaggctgatgggaaaatcactccgtggccagattccagagatctagacctctctgattgctga

SEQ ID NO: 471 - protein, 360 aa, Homo sapiens
MEECWVTEIANGSKDGLDSNPMKDYMILSGPQKTAVAVLCTLLGLLSALENVAVLYLILSSHQLRRKPSYLFIGSLAGADFLASVVFACSFVNFHVFHGVDSKAVFLLKIGSVTMTFTASVGSLLLTAIDRYLCLRYPPSYKALLTRGRALVTLGIMWVLSALVSYLPLMGWTCCPRPCSELFPLIPNDYLLSWLLFIAFLFSGIIYTYGHVLWKAHQHVASLSGHQDRQVPGMARMRLDVRLKKTLGLVLAVLLICWFPVLALMAHSLATTLSDQVKKAFAFCSMLCLINSMVNPVIYALRSGEIRSSAHHCLAHWKKCVRGLGSEAKEEAPRSSVTETEADGKITPWPDSRDLDLSDC

SEQ ID NO: 472 - DNA, 1083 bp, Homo sapiens
atgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcaaagagagtcatcttcaccatcatgattgtttactttctcttctggactccctataacattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaaggtatctctcggtgttcttccgaaagcacatcaccaagcgcttctgcaaacaatgtccagttttctacagggagacagtggatggagtgacttcaacaaacacgccttccactggggagcaggaagtctcggctggtttataa

SEQ ID NO: 473 - protein, 360 aa, Homo sapiens
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAKRVIFTIMIVYFLFWTPYNIVILLNTFQEFFGLSNCESTSQLDQATQVTETLGMTHCCINPIIYAFVGEKFRRYLSVFFRKHITKRFCKQCPVFYRETVDGVTSTNTPSTGEQEVSAGL

SEQ ID NO: 474 - DNA, 1068 bp, Homo sapiens
atgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacctgctcttcctcgtcacccttccattctggatccactatgtcagggggcataactgggtttttggccatggcatgtgtaagctcctctcagggttttatcacacaggcttgtacagcgagatctttttcataatcctgctgacaatcgacaggtacctggccattgtccatgctgtgtttgcccttcgagcccggactgtcacttttggtgtcatcaccagcatcgtcacctggggcctggcagtgctagcagctcttcctgaatttatcttctatgagactgaagagttgtttgaagagactctttgcagtgctctttacccagaggatacagtatatagctggaggcatttccacactctgagaatgaccatcttctgtctcgttctccctctgctcgttatggccatctgctacacaggaatcatcaaaacgctgctgaggtgccccagtaaaaaaaagtacaaggccaagcggctcatttttgtcatcatggcggtgtttttcattttctggacaccctacaatgtggctatccttctctcttcctatcaatccatcttatttggaaatgactgtgagcggagcaagcatctggacctggtcatgctggtgacagaggtgatcgcctactcccactgctgcatgaacccggtgatctacgcctttgttggagagaggttccggaagtacctgcgccacttcttccacaggcacttgctcatgcacctgggcagatacatcccattccttcctagtgagaagctggaaagaaccagctctgtctctccatccacagcagagccggaactctctattgtgttttag

SEQ ID NO: 475 - protein, 355 aa, Homo sapiens
MTTSLDTVETFGTTSYYDDVGLLCEKADTRALMAQFVPPLYSLVFTVGLLGNVVVVMILIKYRRLRIMTNIYLLNLAISDLLFLVTLPFWIHYVRGHNWVFGHGMCKLLSGFYHTGLYSEIFFIILLTIDRYLAIVHAVFALRARTVTFGVITSIVTWGLAVLAALPEFIFYETEELFEETLCSALYPEDTVYSWRHFHTLRMTIFCLVLPLLVMAICYTGIIKTLLRCPSKKKYKAKRLIFVIMAVFFIFWTPYNVAILLSSYQSILFGNDCERSKHLDLVMLVTEVIAYSHCCMNPVIYAFVGERFRKYLRHFFHRHLLMHLGRYIPFLPSEKLERTSSVSPSTAEPELSIVF

SEQ ID NO: 476 - DNA, 1059 bp, Homo sapiens
atggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctaagaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtga

SEQ ID NO: 477 - protein, 352 aa, Homo sapiens
MDYQVSSPIYDINYYTSEPCQKINVKQIAARLLPPLYSLVFIFGFVGNMLVILILINCKRLKSMTDIYLLNLAISDLFFLLTVPFWAHYAAAQWDFGNTMCQLLTGLYFIGFFSGIFFIILLTIDRYLAVVHAVFALKARTVTFGVVTSVITWVVAVFASLPGIIFTRSQKEGLHYTCSSHFPYSQYQFWKNFQTLKIVILGLVLPLLVMVICYSGILKTLLRCRNEKKRHRAKRLIFTIMIVYFLFWAPYNIVLLLNTFQEFFGLNNCSSSNRLDQAMQVTETLGMTHCCINPIIYAFVGEKFRNYLLVFFQKHIAKRFCKCCSIFQQEAPERASSVYTRSTGEQEISVGL

SEQ ID NO: 478 - DNA, 1068 bp, Homo sapiens
atggattatacacttgacctcagtgtgacaacagtgaccgactactactaccctgatatcttctcaagcccctgtgatgcggaacttattcagacaaatggcaagttgctccttgctgtcttttattgcctcctgtttgtattcagtcttctgggaaacagcctggtcatcctggtccttgtggtctgcaagaagctgaggagcatcacagatgtatacctcttgaacctggccctgtctgacctgctttttgtcttctccttcccctttcagacctactatctgctggaccagtgggtgtttgggactgtaatgtgcaaagtggtgtctggcttttattacattggcttctacagcagcatgtttttcatcaccctcatgagtgtggacaggtacctggctgttgtccatgccgtgtatgccctaaaggtgaggacgatcaggatgggcacaacgctgtgcctggcagtatggctaaccgccattatggctaccatcccattgctagtgttttaccaagtggcctctgaagatggtgttctacagtgttattcattttacaatcaacagactttgaagtggaagatcttcaccaacttcaaaatgaacattttaggcttgttgatcccattcaccatctttatgttctgctacattaaaatcctgcaccagctgaagaggtgtcaaaaccacaacaagaccaaggccaagaggttggtgctcattgtggtcattgcatctttacttttctgggtcccattcaacgtggttcttttcctcacttccttgcacagtatgcacatcttggatggatgtagcataagccaacagctgacttatgccacccatgtcacagaaatcatttcctttactcactgctgtgtgaaccctgttatctatgcttttgttggggagaagttcaagaaacacctctcagaaatatttcagaaaagttgcagccaaatcttcaactacctaggaagacaaatgcctagggagagctgtgaaaagtcatcatcctgccagcagcactcctcccgttcctccagcgtagactacattttgtga

SEQ ID NO: 479 - protein, 355 aa, Homo sapiens
MDYTLDLSVTTVTDYYYPDIFSSPCDAELIQTNGKLLLAVFYCLLFVFSLLGNSLVILVLVVCKKLRSITDVYLLNLALSDLLFVFSFPFQTYYLLDQWVFGTVMCKVVSGFYYIGFYSSMFFITLMSVDRYLAVVHAVYALKVRTIRMGTTLCLAVWLTAIMATIPLLVFYQVASEDGVLQCYSFYNQQTLKWKIFTNFKMNILGLLIPFTIFMFCYIKILHQLKRCQNHNKTKAKRLVLIVVIASLLFWVPFNVVLFLTSLHSMHILDGCSISQQLTYATHVTEIISFTHCCVNPVIYAFVGEKFKKHLSEIFQKSCSQIFNYLGRQMPRESCEKSSSCQQHSSRSSSVDYIL

SEQ ID NO: 480 - DNA, 1110 bp, Homo sapiens
atgacacccacagacttcacaagccctattcctaacatggctgatgactatggctctgaatccacatcttccatggaagactacgttaacttcaacttcactgacttctactgtgagaaaaacaatgtcaggcagtttgcgagccatttcctcccacccttgtactggctcgtgttcatcgtgggtgccttgggcaacagtcttgttatccttgtctactggtactgcacaagagtgaagaccatgaccgacatgttccttttgaatttggcaattgctgacctcctctttcttgtcactcttcccttctgggccattgctgctgctgaccagtggaagttccagaccttcatgtgcaaggtggtcaacagcatgtacaagatgaacttctacagctgtgtgttgctgatcatgtgcatcagcgtggacaggtacattgccattgcccaggccatgagagcacatacttggagggagaaaaggcttttgtacagcaaaatggtttgctttaccatctgggtattggcagctgctctctgcatcccagaaatcttatacagccaaatcaaggaggaatccggcattgctatctgcaccatggtttaccctagcgatgagagcaccaaactgaagtcagctgtcttgaccctgaaggtcattctggggttcttccttcccttcgtggtcatggcttgctgctataccatcatcattcacaccctgatacaagccaagaagtcttccaagcacaaagccaaaaaagtgaccatcactgtcctgaccgtctttgtcttgtctcagtttccctacaactgcattttgttggtgcagaccattgacgcctatgccatgttcatctccaactgtgccgtttccaccaacattgacatctgcttccaggtcacccagaccatcgccttcttccacagttgcctgaaccctgttctctatgtttttgtgggtgagagattccgccgggatctcgtgaaaaccctgaagaacttgggttgcatcagccaggcccagtgggtttcatttacaaggagagagggaagcttgaagctgtcgtctatgttgctggagacaacctcaggagcactctccctctga

SEQ ID NO: 481 - protein, 369 aa, Homo sapiens
MTPTDFTSPIPNMADDYGSESTSSMEDYVNFNFTDFYCEKNNVRQFASHFLPPLYWLVFIVGALGNSLVILVYWYCTRVKTMTDMFLLNLAIADLLFLVTLPFWAIAAADQWKFQTFMCKVVNSMYKMNFYSCVLLIMCISVDRYIAIAQAMRAHTWREKRLLYSKMVCFTIWVLAAALCIPEILYSQIKEESGIAICTMVYPSDESTKLKSAVLTLKVILGFFLPFVVMACCYTIIIHTLIQAKKSSKHKAKKVTITVLTVFVLSQFPYNCILLVQTIDAYAMFISNCAVSTNIDICFQVTQTIAFFHSCLNPVLYVFVGERFRRDLVKTLKNLGCISQAQWVSFTRREGSLKLSSMLLETTSGALSL

SEQ ID NO: 482 - DNA, 1248 bp, Homo sapiens
atgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagcccctctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctga

SEQ ID NO: 483 - protein, 415 aa, Homo sapiens
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKAPLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 484 - DNA, 1059 bp, Homo sapiens
atggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccaagaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaa

SEQ ID NO: 485 - protein, 352 aa, Homo sapiens
MEGISIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKAKKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 486 - DNA, 1341 bp, Homo sapiens
atgaggactctgaacacctctgccatggacgggactgggctggtggtggagagggacttctctgttcgtatcctcactgcctgtttcctgtcgctgctcatcctgtccacgctcctggggaacacgctggtctgtgctgccgttatcaggttccgacacctgcggtccaaggtgaccaacttctttgtcatctccttggctgtgtcagatctcttggtggccgtcctggtcatgccctggaaggcagtggctgagattgctggcttctggccctttgggtccttctgtaacatctgggtggcctttgacatcatgtgctccactgcatccatcctcaacctctgtgtgatcagcgtggacaggtattgggctatctccagccctttccggtatgagagaaagatgacccccaaggcagccttcatcctgatcagtgtggcatggaccttgtctgtactcatctccttcatcccagtgcagctcagctggcacaaggcaaaacccacaagcccctctgatggaaatgccacttccctggctgagaccatagacaactgtgactccagcctcagcaggacatatgccatctcatcctctgtaataagcttttacatccctgtggccatcatgattgtcacctacaccaggatctacaggattgctcagaaacaaatacggcgcattgcggccttggagagggcagcagtccacgccaagaattgccagaccaccacaggtaatggaaagcctgtcgaatgttctcaaccggaaagttcttttaagatgtccttcaaaagagaaactaaagtcaagaagactctgtcggtgatcatgggtgtgtttgtgtgctgttggctacctttcttcatcttgaactgcattttgcccttctgtgggtctggggagacgcagcccttctgcattgattccaacacctttgacgtgtttgtgtggtttgggtgggctaattcatccttgaaccccatcatttatgcctttaatgctgattttcggaaggcattttcaaccctcttaggatgctacagactttgccctgcgacgaataatgccatagagacggtgagtatcaataacaatggggccgcgatgttttccagccatcatgagccacgaggctccatctccaaggagtgcaatctggtttacctgatcccacatgctgtgggctcctctgaggacctgaaaaaggaggaggcagctggcatcgccagacccttggagaagctgtccccagccctatcggtcatattggactatgacactgacgtctctctggagaagatccaacccatgacacaaaacggtcagcacccaacctga

SEQ ID NO: 487 - protein, 446 aa, Homo sapiens
MRTLNTSAMDGTGLVVERDFSVRILTACFLSLLILSTLLGNTLVCAAVIRFRHLRSKVTNFFVISLAVSDLLVAVLVMPWKAVAEIAGFWPFGSFCNIWVAFDIMCSTASILNLCVISVDRYWAISSPFRYERKMTPKAAFILISVAWTLSVLISFIPVQLSWHKAKPTSPSDGNATSLAETIDNCDSSLSRTYAISSSVISFYIPVAIMIVTYTRIYRIAQKQIRRIAALERAAVHAKNCQTTTGNGKPVECSQPESSFKMSFKRETKVKKTLSVIMGVFVCCWLPFFILNCILPFCGSGETQPFCIDSNTFDVFVWFGWANSSLNPIIYAFNADFRKAFSTLLGCYRLCPATNNAIETVSINNNGAAMFSSHHEPRGSISKECNLVYLIPHAVGSSEDLKKEEAAGIARPLEKLSPALSVILDYDTDVSLEKIQPMTQNGQHPT

SEQ ID NO: 488 - DNA, 1332 bp, Homo sapiens
atggatccactgaatctgtcctggtatgatgatgatctggagaggcagaactggagccggcccttcaacgggtcagacgggaaggcggacagaccccactacaactactatgccacacggctcaccctgctcatcgctgtcatcgtcttcggcaacgtgctggtgtgcatggctgtgtcccgcgagaaggcgctgcagaccaccaccaactacctgatcgtcagccttgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtagaggctgcccggcgagcccaggagctggagatggagatgctctccagcaccagcccacccgagaggacccggtacagccccatccctcccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccaatcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctga

SEQ ID NO: 489 - protein, 443 aa, Homo sapiens
MDPLNLSWYDDDLERQNWSRPFNGSDGKADRPHYNYYATRLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKGNCTHPEDMKLCTVIMKSNGSFPVNRRRVEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKAKQMLAIVLGVFIICWLPFFITHILNIHCDCNIPPVLYSAFTWLGYVNSAVNPIIYTTFNIEFRKAFLKILHC

SEQ ID NO: 490 - DNA, 1203 bp, Homo sapiens
atggcatctctgagtcagctgagtagccacctgaactacacctgtggggcagagaactccacaggtgccagccaggcccgcccacatgcctactatgccctctcctactgcgcgctcatcctggccatcgtcttcggcaatggcctggtgtgcatggctgtgctgaaggagcgggccctgcagactaccaccaactacttagtagtgagcctggctgtggcagacttgctggtggccaccttggtgatgccctgggtggtatacctggaggtgacaggtggagtctggaatttcagccgcatttgctgtgatgtttttgtcaccctggatgtcatgatgtgtacagccagcatccttaatctctgtgccatcagcatagacaggtacactgcagtggtcatgcccgttcactaccagcatggcacgggacagagctcctgtcggcgcgtggccctcatgatcacggccgtctgggtactggcctttgctgtgtcctgccctcttctgtttggctttaataccacaggggaccccactgtctgctccatctccaaccctgattttgtcatctactcttcagtggtgtccttctacctgccctttggagtgactgtccttgtctatgccagaatctatgtggtgctgaaacaaaggagacggaaaaggatcctcactcgacagaacagtcagtgcaacagtgtcaggcctggcttcccccaacaaaccctctctcctgacccggcacatctggagctgaagcgttactacagcatctgccaggacactgccttgggtggaccaggcttccaagaaagaggaggagagttgaaaagagaggagaagactcggaattccctgagtcccaccatagcgcccaagctcagcttagaagttcgaaaactcagcaatggcagattatcgacatctttgaagctggggcccctgcaacctcggggagtgccacttcgggagaagaaggcaaaacaaatggtggccattgtgcttggggccttcattgtctgctggctgcccttcttcttgacccatgttctcaatacccactgccagacatgccacgtgtccccagagctttacagtgccacgacatggctgggctacgtgaatagcgccctcaaccctgtgatctataccaccttcaatatcgagttccggaaagccttcctcaagatcctgtcttgctga

SEQ ID NO: 491 - protein, 400 aa, Homo sapiens
MASLSQLSSHLNYTCGAENSTGASQARPHAYYALSYCALILAIVFGNGLVCMAVLKERALQTTTNYLVVSLAVADLLVATLVMPWVVYLEVTGGVWNFSRICCDVFVTLDVMMCTASILNLCAISIDRYTAVVMPVHYQHGTGQSSCRRVALMITAVWVLAFAVSCPLLFGFNTTGDPTVCSISNPDFVIYSSVVSFYLPFGVTVLVYARIYVVLKQRRRKRILTRQNSQCNSVRPGFPQQTLSPDPAHLELKRYYSICQDTALGGPGFQERGGELKREEKTRNSLSPTIAPKLSLEVRKLSNGRLSTSLKLGPLQPRGVPLREKKAKQMVAIVLGAFIVCWLPFFLTHVLNTHCQTCHVSPELYSATTWLGYVNSALNPVIYTTFNIEFRKAFLKILSC

SEQ ID NO: 492 - DNA, 1434 bp, Homo sapiens
atgctgccgccaggcagcaacggcaccgcgtacccggggcagttcgctctataccagcagctggcgcaggggaacgccgtggggggctcggcgggggcaccgccactggggccctcacaggtggtcaccgcctgcctgctgaccctactcatcatctggaccctgctgggcaacgtgctggtgtgcgcagccatcgtgcggagccgccacctgcgcgccaacatgaccaacgtcttcatcgtgtctctggccgtgtctgaccttttcgtggcgctgctggtcatgccctggaaggcagtcgccgaggtggccggttactggccctttggagcgttctgcgacgtctgggtggccttcgacatcatgtgctccactgcctccatcctgaacctgtgcgtcatcagcgtggaccgctactgggccatctccaggcccttccgctacaagcgcaagatgactcagcgcatggccttggtcatggtcggcctggcatggaccttgtccatcctcatctccttcattccggtccagctcaactggcacagggaccaggcggcctcttggggcgggctggacctgccaaacaacctggccaactggacgccctgggaggaggacttttgggagcccgacgtgaatgcagagaactgtgactccagcctgaatcgaacctacgccatctcttcctcgctcatcagcttctacatccccgttgccatcatgatcgtgacctacacgcgcatctaccgcatcgcccaggtgcagatccgcaggatttcctccctggagagggccgcagagcacgcgcagagctgccggagcagcgcagcctgcgcgcccgacaccagcctgcgcgcttccatcaagaaggagaccaaggttaaaaagaccctgtcggtgatcatgggggtcttcgtgtgttgctggctgcccttcttcatccttaactgcatggtccctttctgcagtggacaccctgaaggccctccggccggcttcccctgcgtcagtgagaccaccttcgacgtcttcgtctggttcggctgggctaactcctcactcaaccccgtcatctatgccttcaacgccgactttcagaaggtgtttgcccagctgctggggtgcagccacttctgctcccgcacgccggtggagacggtgaacatcagcaatgagctcatctcctacaaccaagacatcgtcttccacaaggaaatcgcagctgcctacatccacatgatgcccaacgccgttacccccggcaaccgggaggtggacaacgacgaggaggagggtcctttcgatcgcatgttccagatctatcagacgtccccagatggtgaccctgttgctgagtctgtctgggagctggactgcgagggggagatttctttagacaaaataacacctttcaccccgaatggattccattaa

SEQ ID NO: 493 - protein, 477 aa, Homo sapiens
MLPPGSNGTAYPGQFALYQQLAQGNAVGGSAGAPPLGPSQVVTACLLTLLIIWTLLGNVLVCAAIVRSRHLRANMTNVFIVSLAVSDLFVALLVMPWKAVAEVAGYWPFGAFCDVWVAFDIMCSTASILNLCVISVDRYWAISRPFRYKRKMTQRMALVMVGLAWTLSILISFIPVQLNWHRDQAASWGGLDLPNNLANWTPWEEDFWEPDVNAENCDSSLNRTYAISSSLISFYIPVAIMIVTYTRIYRIAQVQIRRISSLERAAEHAQSCRSSAACAPDTSLRASIKKETKVKKTLSVIMGVFVCCWLPFFILNCMVPFCSGHPEGPPAGFPCVSETTFDVFVWFGWANSSLNPVIYAFNADFQKVFAQLLGCSHFCSRTPVETVNISNELISYNQDIVFHKEIAAAYIHMMPNAVTPGNREVDNDEEEGPFDRMFQIYQTSPDGDPVAESVWELDCEGEISLDKITPFTPNGFH

SEQ ID NO: 494 - DNA, 1284 bp, Homo sapiens
atggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagctgctggctgggcgctggccttttgatcacaatgactttggcgtatttctttgcaagctgttcccctttttgcagaagtcctcggtggggatcaccgtcctcaacctctgcgctcttagtgttgacaggtacagagcagttgcctcctggagtcgtgttcagggaattgggattcctttggtaactgccattgaaattgtctccatctggatcctgtcctttatcctggccattcctgaagcgattggcttcgtcatggtaccctttgaatataggggtgaacagcataaaacctgtatgctcaatgccacatcaaaattcatggagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtgaaaaaaacagttttctgcttggttgtaatttttgctctttgctggttccctcttcacttaagccgtatattgaagaaaactgtgtataacgaaatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactga

SEQ ID NO: 495 - protein, 427 aa, Homo sapiens
METLCLRASFWLALVGCVISDNPERYSTNLSNHVDDFTTFRGTELSFLVTTHQPTNLVLPSNGSMHNYCPQQTKITSAFKYINTVISCTIFIVGMVGNATLLRIIYQNKCMRNGPNALIASLALGDLIYVVIDLPINVFKLLAGRWPFDHNDFGVFLCKLFPFLQKSSVGITVLNLCALSVDRYRAVASWSRVQGIGIPLVTAIEIVSIWILSFILAIPEAIGFVMVPFEYRGEQHKTCMLNATSKFMEFYQDVKDWWLFGFYFCMPLVCTAIFYTLMTCEMLNRRNGSLRIALSEHLKQRREVKKTVFCLVVIFALCWFPLHLSRILKKTVYNEMDKNRCELLSFLLLMDYIGINLATMNSCINPIALYFVSKKFKNCFQSCLCCCCYQSKSLMTSVPMNGTSIQWKNHDQNNHNTDRSSHKDSMN

SEQ ID NO: 496 - DNA, 1329 bp, Homo sapiens
atgcagccgcctccaagtctgtgcggacgcgccctggttgcgctggttcttgcctgcggcctgtcgcggatctggggagaggagagaggcttcccgcccgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgatcacctaaagcagagacgggaagtgaagaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttga

SEQ ID NO: 497 - protein, 442 aa, Homo sapiens
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVKKTVFCLVLVFALCWLPLHLSRILKLTLYNQNDPNRCELLSFLLVLDYIGINMASLNSCINPIALYLVSKRFKNCFKSCLCCWCQSFEEKQSLEEKQSCLKFKANDHGYDNFRSSNKYSSS

SEQ ID NO: 498 - DNA, 1053 bp, Homo sapiens
atggagacaaattcctctctccccacgaacatctctggagggacacctgctgtatctgctggctatctcttcctggatatcatcacttatctggtatttgcagtcacctttgtcctcggggtcctgggcaacgggcttgtgatctgggtggctggattccggatgacacacacagtcaccaccatcagttacctgaacctggccgtggctgacttctgtttcacctccactttgccattcttcatggtcaggaaggccatgggaggacattggcctttcggctggttcctgtgcaaattcgtctttaccatagtggacatcaacttgttcggaagtgtcttcctgatcgccctcattgctctggaccgctgtgtttgcgtcctgcatccagtctggacccagaaccaccgcaccgtgagcctggccaagaaggtgatcattgggccctgggtgatggctctgctcctcacattgccagttatcattcgtgtgactacagtacctggtaaaacggggacagtagcctgcacttttaacttttcgccctggaccaacgaccctaaagagaggataaatgtggccgttgccatgttgacggtgagaggcatcatccggttcatcattggcttcagcgcacccatgtccatcgttgctgtcagttatgggcttattgccaccaagatccacaagcaaggcttgattaagtccagtcgtcccaaacgggtcctctcctttgtcgcagcagccttttttctctgctggtccccatatcaggtggtggcccttatagccacagtcagaatccgtgagttattgcaaggcatgtacaaagaaattggtattgcagtggatgtgacaagtgccctggccttcttcaacagctgcctcaaccccatgctctatgtcttcatgggccaggacttccgggagaggctgatccacgcccttcccgccagtctggagagggccctgaccgaggactcaacccaaaccagtgacacagctaccaattctactttaccttctgcagaggtggagttacaggcaaagtga

SEQ ID NO: 499 - protein, 350 aa, Homo sapiens
METNSSLPTNISGGTPAVSAGYLFLDIITYLVFAVTFVLGVLGNGLVIWVAGFRMTHTVTTISYLNLAVADFCFTSTLPFFMVRKAMGGHWPFGWFLCKFVFTIVDINLFGSVFLIALIALDRCVCVLHPVWTQNHRTVSLAKKVIIGPWVMALLLTLPVIIRVTTVPGKTGTVACTFNFSPWTNDPKERINVAVAMLTVRGIIRFIIGFSAPMSIVAVSYGLIATKIHKQGLIKSSRPKRVLSFVAAAFFLCWSPYQVVALIATVRIRELLQGMYKEIGIAVDVTSALAFFNSCLNPMLYVFMGQDFRERLIHALPASLERALTEDSTQTSDTATNSTLPSAEVELQAK

SEQ ID NO: 500 - DNA, 1056 bp, Homo sapiens
atggaaaccaacttctccactcctctgaatgaatatgaagaagtgtcctatgagtctgctggctacactgttctgcggatcctcccattggtggtgcttggggtcacctttgtcctcggggtcctgggcaatgggcttgtgatctgggtggctggattccggatgacacgcacagtcaccaccatctgttacctgaacctggccctggctgacttttctttcacggccacattaccattcctcattgtctccatggccatgggagaaaaatggccttttggctggttcctgtgtaagttaattcacatcgtggtggacatcaacctctttggaagtgtcttcttgattggtttcattgcactggaccgctgcatttgtgtcctgcatccagtctgggcccagaaccaccgcactgtgagtctggccatgaaggtgatcgtcggaccttggattcttgctctagtccttaccttgccagttttcctctttttgactacagtaactattccaaatggggacacatactgtactttcaactttgcatcctggggtggcacccctgaggagaggctgaaggtggccattaccatgctgacagccagagggattatccggtttgtcattggctttagcttgccgatgtccattgttgccatctgctatgggctcattgcagccaagatccacaaaaagggcatgattaaatccagccgtcccaaacgggtcctcactgctgtggtggcttctttcttcatctgttggtttccctttcaactggttgcccttctgggcaccgtctggctcaaagagatgttgttctatggcaagtacaaaatcattgacatcctggttaacccaacgagctccctggccttcttcaacagctgcctcaaccccatgctttacgtctttgtgggccaagacttccgagagagactgatccactccctgcccaccagtctggagagggccctgtctgaggactcagccccaactaatgacacggctgccaattctgcttcacctcctgcagagactgagttacaggcaatgtga

SEQ ID NO: 501 - protein, 351 aa, Homo sapiens
METNFSTPLNEYEEVSYESAGYTVLRILPLVVLGVTFVLGVLGNGLVIWVAGFRMTRTVTTICYLNLALADFSFTATLPFLIVSMAMGEKWPFGWFLCKLIHIVVDINLFGSVFLIGFIALDRCICVLHPVWAQNHRTVSLAMKVIVGPWILALVLTLPVFLFLTTVTIPNGDTYCTFNFASWGGTPEERLKVAITMLTARGIIRFVIGFSLPMSIVAICYGLIAAKIHKKGMIKSSRPKRVLTAVVASFFICWFPFQLVALLGTVWLKEMLFYGKYKIIDILVNPTSSLAFFNSCLNPMLYVFVGQDFRERLIHSLPTSLERALSEDSAPTNDTAANSASPPAETELQAM

SEQ ID NO: 502 - DNA, 1050 bp, Homo sapiens
atggagctggcggtcgggaacctcagcgagggcaacgcgagctgtccggagccccccgccccggagcccgggccgctgttcggcatcggcgtggagaacttcgtcacgctggtggtgttcggcctgatcttcgcgctgggcgtgctgggcaacagcctagtgatcaccgtgctggcgcgcagcaagccgggcaagccgcggagcaccaccaacctgttcatcctcaacctgagcatcgccgacctggcctacctgctcttctgcatccccttccaggccaccgtgtacgcgctgcccacctgggtgctgggcgccttcatctgcaagttcatccactacttcttcaccgtgtccatgctggtgagcatcttcaccctggccgcgatgtccgtggaccgctacgtggccatcgtgcactcgcggcgctcctcctccctcagggtgtcccgcaacgcgctgctgggcgtgggctgcatctgggcgctgtccattgccatggcctcgcccgtggcctaccaccagggcctcttccacccgcgcgccagcaaccagaccttctgctgggagcagtggcccgaccctcgccacaagaaggcctacgtggtgtgcaccttcgtcttcggctacctgctgccgctcctgctcatctgcttctgctatgccaaggtccttaatcacttgcataaaaagttgaagaacatgtcaaagaagtctgaagcatccaagaaaaagactaaacagacagttctggtggtggttgtggtgtttggaatctcctggctgccgcaccacatcatccatctctgggctgagtttggagttttcccgctgacgccggcttccttcctcttcagaatcaccgcccactgcctggcgtacagcaattcctccgtgaatcctatcatttatgcatttctctctgaaaatttcaggaaggcctataaacaagtgttcaagtgtcacattcgcaaagattcacacctgagtgatactaaagaaaataaaagtcgaatagacaccccaccatcaaccaattgtactcatgtgtga

SEQ ID NO: 503 - protein, 349 aa, Homo sapiens
MELAVGNLSEGNASCPEPPAPEPGPLFGIGVENFVTLVVFGLIFALGVLGNSLVITVLARSKPGKPRSTTNLFILNLSIADLAYLLFCIPFQATVYALPTWVLGAFICKFIHYFFTVSMLVSIFTLAAMSVDRYVAIVHSRRSSSLRVSRNALLGVGCIWALSIAMASPVAYHQGLFHPRASNQTFCWEQWPDPRHKKAYVVCTFVFGYLLPLLLICFCYAKVLNHLHKKLKNMSKKSEASKKKTKQTVLVVVVVFGISWLPHHIIHLWAEFGVFPLTPASFLFRITAHCLAYSNSSVNPIIYAFLSENFRKAYKQVFKCHIRKDSHLSDTKENKSRIDTPPSTNCTHV

SEQ ID NO: 504 - DNA, 1164 bp, Homo sapiens
atgaacgtctcgggctgcccaggggccgggaacgcgagccaggcgggcggcgggggaggctggcaccccgaggcggtcatcgtgcccctgctcttcgcgctcatcttcctcgtgggcaccgtgggcaacacgctggtgctggcggtgctgctgcgcggcggccaggcggtcagcactaccaacctgttcatccttaacctgggcgtggccgacctgtgtttcatcctgtgctgcgtgcccttccaggccaccatctacaccctggacggctgggtgttcggctcgctgctgtgcaaggcggtgcacttcctcatcttcctcaccatgcacgccagcagcttcacgctggccgccgtctccctggacaggtatctggccatccgctacccgctgcactcccgcgagctgcgcacgcctcgaaacgcgctggcagccatcgggctcatctgggggctgtcgctgctcttctccgggccctacctgagctactaccgccagtcgcagctggccaacctgaccgtgtgccatcccgcgtggagcgcccctcgccgccgcgccatggacatctgcaccttcgtcttcagctacctgcttcctgtgctggttctcggcctgacctacgcgcgcaccttgcgctacctctggcgcgccgtcgacccggtggccgcgggctcgggtgcccggcgcgccaagcgcaaggtgaaacgcatgatcctcatcgtggccgcgctcttctgcctctgctggatgccccaccacgcgctcatcctctgcgtgtggttcggccagttcccgctcacgcgcgccacttatgcgcttcgcatcctctcgcacctggtctcctacgccaactcctgcgtcaaccccatcgtttacgcgctggtctccaagcacttccgcaaaggcttccgcacgatctgcgcgggcctgctgggccgtgccccaggccgagcctcgggccgtgtgtgcgctgccgcgcggggcacccacagtggcagcgtgttggagcgcgagtccagcgacctgttgcacatgagcgaggcggcgggggcccttcgtccctgccccggcgcttcccagccatgcatcctcgagccctgtcctggcccgtcctggcagggcccaaaggcaggcgacagcatcctgacggttgatgtggcctga

SEQ ID NO: 505 - protein, 387 aa, Homo sapiens
MNVSGCPGAGNASQAGGGGGWHPEAVIVPLLFALIFLVGTVGNTLVLAVLLRGGQAVSTTNLFILNLGVADLCFILCCVPFQATIYTLDGWVFGSLLCKAVHFLIFLTMHASSFTLAAVSLDRYLAIRYPLHSRELRTPRNALAAIGLIWGLSLLFSGPYLSYYRQSQLANLTVCHPAWSAPRRRAMDICTFVFSYLLPVLVLGLTYARTLRYLWRAVDPVAAGSGARRAKRKVKRMILIVAALFCLCWMPHHALILCVWFGQFPLTRATYALRILSHLVSYANSCVNPIVYALVSKHFRKGFRTICAGLLGRAPGRASGRVCAAARGTHSGSVLERESSDLLHMSEAAGALRPCPGASQPCILEPCPGPSWQGPKAGDSILTVDVA

SEQ ID NO: 506 - DNA, 1401 bp, Homo sapiens
atgactacctctccgatcctgcagctgctgctgcggctctcactgtgcgggctgctgctccagagggcggagacaggctctaaggggcagacggcgggggagctgtaccagcgctgggaacggtaccgcagggagtgccaggagaccttggcagccgcggaaccgccttcaggcctcgcctgtaacgggtccttcgatatgtacgtctgctgggactatgctgcacccaatgccactgcccgtgcgtcctgcccctggtacctgccctggcaccaccatgtggctgcaggtttcgtcctccgccagtgtggcagtgatggccaatggggactttggagagaccatacacaatgtgagaacccagagaagaatgaggcctttctggaccaaaggctcatcttggagcggttgcaggtcatgtacactgtcggctactccctgtctctcgccacactgctgctagccctgctcatcttgagtttgttcaggcggctacattgcactagaaactatatccacatcaacctgttcacgtctttcatgctgcgagctgcggccattctcagccgagaccgtctgctacctcgacctggcccctaccttggggaccaggcccttgcgctgtggaaccaggccctcgctgcctgccgcacggcccagatcgtgacccagtactgcgtgggtgccaactacacgtggctgctggtggagggcgtctacctgcacagtctcctggtgctcgtgggaggctccgaggagggccacttccgctactacctgctcctcggctggggggcccccgcgcttttcgtcattccctgggtgatcgtcaggtacctgtacgagaacacgcagtgctgggagcgcaacgaagtcaaggccatttggtggattatacggacccccatcctcatgaccatcttgattaatttcctcatttttatccgcattcttggcattctcctgtccaagctgaggacacggcaaatgcgctgccgggattaccggctgaggctggctcgctccccgctgacgctggtgcccctgctgggtgtccacgaggtggtgtttgctcccgtgacagaggaacaggcccggggcgccctgcgcttcgccaagctcggctttgagatcttcctcagctccttccagggcttcctggtcagcgtcctctactgcttcatcaacaaggaggtgcagtcggagatccgccgtggctggcaccactgccgcctgcgccgcagcctgggcgaggagcaacgccagctcccggagcgcgccttccgggccctgccctccggctccggcccgggcgaggtccccaccagccgcggcttgtcctcggggaccctcccagggcctgggaatgaggccagccgggagttggaaagttactgctag

SEQ ID NO: 507 - protein, 466 aa, Homo sapiens
MTTSPILQLLLRLSLCGLLLQRAETGSKGQTAGELYQRWERYRRECQETLAAAEPPSGLACNGSFDMYVCWDYAAPNATARASCPWYLPWHHHVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSPLTLVPLLGVHEVVFAPVTEEQARGALRFAKLGFEIFLSSFQGFLVSVLYCFINKEVQSEIRRGWHHCRLRRSLGEEQRQLPERAFRALPSGSGPGEVPTSRGLSSGTLPGPGNEASRELESYC

SEQ ID NO: 508 - DNA, 1002 bp, Homo sapiens
atggagtcctcaggcaacccagagagcaccacctttttttactatgaccttcagagccagccgtgtgagaaccaggcctgggtctttgctaccctcgccaccactgtcctgtactgcctggtgtttctcctcagcctagtgggcaacagcctggtcctgtgggtcctggtgaagtatgagagcctggagtccctcaccaacatcttcatcctcaacctgtgcctctcagacctggtgttcgcctgcttgttgcctgtgtggatctccccataccactggggctgggtgctgggagacttcctctgcaaactcctcaatatgatcttctccatcagcctctacagcagcatcttcttcctgaccatcatgaccatccaccgctacctgtcggtagtgagccccctctccaccctgcgcgtccccaccctccgctgccgggtgctggtgaccatggctgtgtgggtagccagcatcctgtcctccatcctcgacaccatcttccacaaggtgctttcttcgggctgtgattattccgaactcacgtggtacctcacctccgtctaccagcacaacctcttcttcctgctgtccctggggattatcctgttctgctacgtggagatcctcaggaccctgttccgctcacgctccaagcggcgccaccgcacgaaaaagctcatcttcgccatcgtggtggcctacttcctcagctggggtccctacaacttcaccctgtttctgcagacgctgtttcggacccagatcatccggagctgcgaggccaaacagcagctagaatacgccctgctcatctgccgcaacctcgccttctcccactgctgctttaacccggtgctctatgtcttcgtgggggtcaagttccgcacacacctgaaacatgttctccggcagttctggttctgccggctgcaggcacccagcccagcctcgatcccccactcccctggtgccttcgcctatgagggcgcctccttctactga

SEQ ID NO: 509 - protein, 333 aa, Homo sapiens
MESSGNPESTTFFYYDLQSQPCENQAWVFATLATTVLYCLVFLLSLVGNSLVLWVLVKYESLESLTNIFILNLCLSDLVFACLLPVWISPYHWGWVLGDFLCKLLNMIFSISLYSSIFFLTIMTIHRYLSVVSPLSTLRVPTLRCRVLVTMAVWVASILSSILDTIFHKVLSSGCDYSELTWYLTSVYQHNLFFLLSLGIILFCYVEILRTLFRSRSKRRHRTKKLIFAIVVAYFLSWGPYNFTLFLQTLFRTQIIRSCEAKQQLEYALLICRNLAFSHCCFNPVLYVFVGVKFRTHLKHVLRQFWFCRLQAPSPASIPHSPGAFAYEGASFY

SEQ ID NO: 510 - DNA, 1155 bp, Homo sapiens
atggctctaaatgactgtttccttctgaacttggaggtggaccatttcatgcactgcaacatctccagtcacagtgcggatctccccgtgaacgatgactggtcccacccggggatcctctatgtcatccctgcagtttatggggttatcattctgataggcctcattggcaacatcactttgatcaagatcttctgtacagtcaagtccatgcgaaacgttccaaacctgttcatttccagtctggctttgggagacctgctcctcctaataacgtgtgctccagtggatgccagcaggtacctggctgacagatggctatttggcaggattggctgcaaactgatcccctttatacagcttacctctgttggggtgtctgtcttcacactcacggcgctctcggcagacagatacaaagccattgtccggccaatggatatccaggcctcccatgccctgatgaagatctgcctcaaagccgcctttatctggatcatctccatgctgctggccattccagaggccgtgttttctgacctccatcccttccatgaggaaagcaccaaccagaccttcattagctgtgccccatacccacactctaatgagcttcaccccaaaatccattctatggcttcctttctggtcttctacgtcatcccactgtcgatcatctctgtttactactacttcattgctaaaaatctgatccagagtgcttacaatcttcccgtggaagggaatatacatgtcaagaagcagattgaatcccggaagcgacttaagaagacagtgctggtgtttgtgggcctgttcgccttctgctggctccccaatcatgtcatctacctgtaccgctcctaccactactctgaggtggacacctccatgctccactttgtcaccagcatctgtgcccgcctcctggccttcaccaactcctgcgtgaacccctttgccctctacctgctgagcaagagtttcaggaaacagttcaacactcagctgctctgttgccagcctggcctgatcatccggtctcacagcactggaaggagtacaacctgcatgacctccctcaagagtaccaacccctccgtggccacctttagcctcatcaatggaaacatctgtcacgagcggtatgtctag

SEQ ID NO: 511 - protein, 384 aa, Homo sapiens
MALNDCFLLNLEVDHFMHCNISSHSADLPVNDDWSHPGILYVIPAVYGVIILIGLIGNITLIKIFCTVKSMRNVPNLFISSLALGDLLLLITCAPVDASRYLADRWLFGRIGCKLIPFIQLTSVGVSVFTLTALSADRYKAIVRPMDIQASHALMKICLKAAFIWIISMLLAIPEAVFSDLHPFHEESTNQTFISCAPYPHSNELHPKIHSMASFLVFYVIPLSIISVYYYFIAKNLIQSAYNLPVEGNIHVKKQIESRKRLKKTVLVFVGLFAFCWLPNHVIYLYRSYHYSEVDTSMLHFVTSICARLLAFTNSCVNPFALYLLSKSFRKQFNTQLLCCQPGLIIRSHSTGRSTTCMTSLKSTNPSVATFSLINGNICHERYV

SEQ ID NO: 512 - DNA, 1422 bp, Homo sapiens
atgaacacttcagccccacctgctgtcagccccaacatcaccgtcctggcaccaggaaagggtccctggcaagtggccttcattgggatcaccacgggcctcctgtcgctagccacagtgacaggcaacctgctggtactcatctctttcaaggtcaacacggagctcaagacagtcaataactacttcctgctgagcctggcctgtgctgacctcatcatcggtaccttctccatgaacctctataccacgtacctgctcatgggccactgggctctgggcacgctggcttgtgacctctggctggccctggactatgtggccagcaatgcctccgtcatgaatctgctgctcatcagctttgaccgctacttctccgtgactcggcccctgagctaccgtgccaagcgcacaccccgccgggcagctctgatgatcggcctggcctggctggtttcctttgtgctctgggccccagccatcctcttctggcagtacctggtaggggagcggacgatgctagctgggcagtgctacatccagttcctctcccagcccatcatcacctttggcacagccatggctgccttctacctccctgtcacagtcatgtgcacgctctactggcgcatctaccgggagacagagaaccgagcacgggagctggcagcccttcagggctccgagacgccaggcaaagggggtggcagcagcagcagctcagagaggtctcagccaggggctgagggctcaccagagactcctccaggccgctgctgtcgctgctgccgggcccccaggctgctgcaggcctacagctggaaggaagaagaggaagaggacgaaggctccatggagtccctcacatcctcagagggagaggagcctggctccgaagtggtgatcaagatgccaatggtggaccccgaggcacaggcccccaccaagcagcccccacggagctccccaaatacagtcaagaggccgactaagaaagggcgtgatcgagctggcaagggccagaagccccgtggaaaggagcagctggccaagcggaagaccttctcgctggtcaaggagaagaaggcgaaacggaccctgagtgccatcctcctggccttcatcctcacctggacaccgtacaacatcatggtgctggtgtccaccttctgcaaggactgtgttcccgagaccctgtgggagctgggctactggctgtgctacgtcaacagcaccatcaaccccatgtgctacgcactctgcaacaaagccttccgggacacctttcgcctgctgctgctttgccgctgggacaagagacgctggcgcaagatccccaagcgccctggctccgtgcaccgcactccctcccgccaatgctgatagtcccctctcctgcatccctccaccccagtccccggg

SEQ ID NO: 513 - protein, 460 aa, Homo sapiens
MNTSAPPAVSPNITVLAPGKGPWQVAFIGITTGLLSLATVTGNLLVLISFKVNTELKTVNNYFLLSLACADLIIGTFSMNLYTTYLLMGHWALGTLACDLWLALDYVASNASVMNLLLISFDRYFSVTRPLSYRAKRTPRRAALMIGLAWLVSFVLWAPAILFWQYLVGERTMLAGQCYIQFLSQPIITFGTAMAAFYLPVTVMCTLYWRIYRETENRARELAALQGSETPGKGGGSSSSSERSQPGAEGSPETPPGRCCRCCRAPRLLQAYSWKEEEEEDEGSMESLTSSEGEEPGSEVVIKMPMVDPEAQAPTKQPPRSSPNTVKRPTKKGRDRAGKGQKPRGKEQLAKRKTFSLVKEKKAKRTLSAILLAFILTWTPYNIMVLVSTFCKDCVPETLWELGYWLCYVNSTINPMCYALCNKAFRDTFRLLLLCRWDKRRWRKIPKRPGSVHRTPSRQC

SEQ ID NO: 514 - DNA, 1401 bp, Homo sapiens
atgaataactcaacaaactcctctaacaatagcctggctcttacaagtccttataagacatttgaagtggtgtttattgtcctggtggctggatccctcagtttggtgaccattatcgggaacatcctagtcatggtttccattaaagtcaaccgccacctccagaccgtcaacaattactttttattcagcttggcctgtgctgaccttatcataggtgttttctccatgaacttgtacaccctctacactgtgattggttactggcctttgggacctgtggtgtgtgacctttggctagccctggactatgtggtcagcaatgcctcagttatgaatctgctcatcatcagctttgacaggtacttctgtgtcacaaaacctctgacctacccagtcaagcggaccacaaaaatggcaggtatgatgattgcagctgcctgggtcctctctttcatcctctgggctccagccattctcttctggcagttcattgtaggggtgagaactgtggaggatggggagtgctacattcagtttttttccaatgctgctgtcacctttggtacggctattgcagccttctatttgccagtgatcatcatgactgtgctatattggcacatatcccgagccagcaagagcaggataaagaaggacaagaaggagcctgttgccaaccaagaccccgtttctccaagtctggtacaaggaaggatagtgaagccaaacaataacaacatgcccagcagtgacgatggcctggagcacaacaaaatccagaatggcaaagcccccagggatcctgtgactgaaaactgtgttcagggagaggagaaggagagctccaatgactccacctcagtcagtgctgttgcctctaatatgagagatgatgaaataacccaggatgaaaacacagtttccacttccctgggccattccaaagatgagaactctaagcaaacatgcatcagaattggcaccaagaccccaaaaagtgactcatgtaccccaactaataccaccgtggaggtagtggggtcttcaggtcagaatggagatgaaaagcagaatattgtagcccgcaagattgtgaagatgactaagcagcctgcaaaaaagaagcctcctccttcccgggaaaagaaagtcaagaggacaatcttggctattctgttggctttcatcatcacttgggccccatacaatgtcatggtgctcattaacaccttttgtgcaccttgcatccccaacactgtgtggacaattggttactggctttgttacatcaacagcactatcaaccctgcctgctatgcactttgcaatgccaccttcaagaagacctttaaacaccttctcatgtgtcattataagaacataggcgctacaaggtaa

SEQ ID NO: 515 - protein, 466 aa, Homo sapiens
MNNSTNSSNNSLALTSPYKTFEVVFIVLVAGSLSLVTIIGNILVMVSIKVNRHLQTVNNYFLFSLACADLIIGVFSMNLYTLYTVIGYWPLGPVVCDLWLALDYVVSNASVMNLLIISFDRYFCVTKPLTYPVKRTTKMAGMMIAAAWVLSFILWAPAILFWQFIVGVRTVEDGECYIQFFSNAAVTFGTAIAAFYLPVIIMTVLYWHISRASKSRIKKDKKEPVANQDPVSPSLVQGRIVKPNNNNMPSSDDGLEHNKIQNGKAPRDPVTENCVQGEEKESSNDSTSVSAVASNMRDDEITQDENTVSTSLGHSKDENSKQTCIRIGTKTPKSDSCTPTNTTVEVVGSSGQNGDEKQNIVARKIVKMTKQPAKKKPPPSREKKVKRTILAILLAFIITWAPYNVMVLINTFCAPCIPNTVWTIGYWLCYINSTINPACYALCNATFKKTFKHLLMCHYKNIGATR

SEQ ID NO: 516 - DNA, 1773 bp, Homo sapiens
atgaccttgcacaataacagtacaacctcgcctttgtttccaaacatcagctcctcctggatacacagcccctccgatgcagggctgcccccgggaaccgtcactcatttcggcagctacaatgtttctcgagcagctggcaatttctcctctccagacggtaccaccgatgaccctctgggaggtcataccgtctggcaagtggtcttcatcgctttcttaacgggcatcctggccttggtgaccatcatcggcaacatcctggtaattgtgtcatttaaggtcaacaagcagctgaagacggtcaacaactacttcctcttaagcctggcctgtgccgatctgattatcggggtcatttcaatgaatctgtttacgacctacatcatcatgaatcgatgggccttagggaacttggcctgtgacctctggcttgccattgactacgtagccagcaatgcctctgttatgaatcttctggtcatcagctttgacagatacttttccatcacgaggccgctcacgtaccgagccaaacgaacaacaaagagagccggtgtgatgatcggtctggcttgggtcatctcctttgtcctttgggctcctgccatcttgttctggcaatactttgttggaaagagaactgtgcctccgggagagtgcttcattcagttcctcagtgagcccaccattacttttggcacagccatcgctgctttttatatgcctgtcaccattatgactattttatactggaggatctataaggaaactgaaaagcgtaccaaagagcttgctggcctgcaagcctctgggacagaggcagagacagaaaactttgtccaccccacgggcagttctcgaagctgcagcagttacgaacttcaacagcaaagcatgaaacgctccaacaggaggaagtatggccgctgccacttctggttcacaaccaagagctggaaacccagctccgagcagatggaccaagaccacagcagcagtgacagttggaacaacaatgatgctgctgcctccctggagaactccgcctcctccgacgaggaggacattggctccgagacgagagccatctactccatcgtgctcaagcttccgggtcacagcaccatcctcaactccaccaagttaccctcatcggacaacctgcaggtgcctgaggaggagctggggatggtggacttggagaggaaagccgacaagctgcaggcccagaagagcgtggacgatggaggcagttttccaaaaagcttctccaagcttcccatccagctagagtcagccgtggacacagctaagacttctgacgtcaactcctcagtgggtaagagcacggccactctacctctgtccttcaaggaagccactctggccaagaggtttgctctgaagaccagaagtcagatcactaagcggaaaaggatgtccctggtcaaggagaagaaagcgaaacagaccctcagtgcgatcttgcttgccttcatcatcacttggaccccatacaacatcatggttctggtgaacaccttttgtgacagctgcatacccaaaaccttttggaatctgggctactggctgtgctacatcaacagcaccgtgaaccccgtgtgctatgctctgtgcaacaaaacattcagaaccactttcaagatgctgctgctgtgccagtgtgacaaaaaaaagaggcgcaagcagcagtaccagcagagacagtcggtcatttttcacaagcgcgcacccgagcaggccttgtag

SEQ ID NO: 517 - protein, 590 aa, Homo sapiens
MTLHNNSTTSPLFPNISSSWIHSPSDAGLPPGTVTHFGSYNVSRAAGNFSSPDGTTDDPLGGHTVWQVVFIAFLTGILALVTIIGNILVIVSFKVNKQLKTVNNYFLLSLACADLIIGVISMNLFTTYIIMNRWALGNLACDLWLAIDYVASNASVMNLLVISFDRYFSITRPLTYRAKRTTKRAGVMIGLAWVISFVLWAPAILFWQYFVGKRTVPPGECFIQFLSEPTITFGTAIAAFYMPVTIMTILYWRIYKETEKRTKELAGLQASGTEAETENFVHPTGSSRSCSSYELQQQSMKRSNRRKYGRCHFWFTTKSWKPSSEQMDQDHSSSDSWNNNDAAASLENSASSDEEDIGSETRAIYSIVLKLPGHSTILNSTKLPSSDNLQVPEEELGMVDLERKADKLQAQKSVDDGGSFPKSFSKLPIQLESAVDTAKTSDVNSSVGKSTATLPLSFKEATLAKRFALKTRSQITKRKRMSLVKEKKAKQTLSAILLAFIITWTPYNIMVLVNTFCDSCIPKTFWNLGYWLCYINSTVNPVCYALCNKTFRTTFKMLLLCQCDKKKRRKQQYQQRQSVIFHKRAPEQAL

SEQ ID NO: 518 - DNA, 1440 bp, Homo sapiens
atggccaacttcacacctgtcaatggcagctcgggcaatcagtccgtgcgcctggtcacgtcatcatcccacaatcgctatgagacggtggaaatggtcttcattgccacagtgacaggctccctgagcctggtgactgtcgtgggcaacatcctggtgatgctgtccatcaaggtcaacaggcagctgcagacagtcaacaactacttcctcttcagcctggcgtgtgctgatctcatcataggcgccttctccatgaacctctacaccgtgtacatcatcaagggctactggcccctgggcgccgtggtctgcgacctgtggctggccctggactacgtggtgagcaacgcctccgtcatgaaccttctcatcatcagctttgaccgctacttctgcgtcaccaagcctctcacctaccctgcccggcgcaccaccaagatggcaggcctcatgattgctgctgcctgggtactgtccttcgtgctctgggcgcctgccatcttgttctggcagtttgtggtgggtaagcggacggtgcccgacaaccagtgcttcatccagttcctgtccaacccagcagtgacctttggcacagccattgctgccttctacctgcctgtggtcatcatgacggtgctgtacatccacatctccctggccagtcgcagccgagtccacaagcaccggcccgagggcccgaaggagaagaaagccaagacgctggccttcctcaagagcccactaatgaagcagagcgtcaagaagcccccgcccggggaggccgcccgggaggagctgcgcaatggcaagctggaggaggcccccccgccagcgctgccaccgccaccgcgccccgtggctgataaggacacttccaatgagtccagctcaggcagtgccacccagaacaccaaggaacgcccagccacagagctgtccaccacagaggccaccacgcccgccatgcccgcccctcccctgcagccgcgggccctcaacccagcctccagatggtccaagatccagattgtgacgaagcagacaggcaatgagtgtgtgacagccattgagattgtgcctgccacgccggctggcatgcgccctgcggccaacgtggcccgcaagttcgccagcatcgctcgcaaccaggtgcgcaagaagcggcagatggcggcccgggagcgcaaagtgaaacgaacgatctttgccattctgctagccttcatcctcacctggacgccctacaacgtcatggtcctggtgaacaccttctgccagagctgcatccctgacacggtgtggtccattggctactggctctgctacgtcaacagcaccatcaaccctgcctgctatgctctgtgcaacgccacctttaaaaagaccttccggcacctgctgctgtgccagtatcggaacatcggcactgccaggtag

SEQ ID NO: 519 - protein, 479 aa, Homo sapiens
MANFTPVNGSSGNQSVRLVTSSSHNRYETVEMVFIATVTGSLSLVTVVGNILVMLSIKVNRQLQTVNNYFLFSLACADLIIGAFSMNLYTVYIIKGYWPLGAVVCDLWLALDYVVSNASVMNLLIISFDRYFCVTKPLTYPARRTTKMAGLMIAAAWVLSFVLWAPAILFWQFVVGKRTVPDNQCFIQFLSNPAVTFGTAIAAFYLPVVIMTVLYIHISLASRSRVHKHRPEGPKEKKAKTLAFLKSPLMKQSVKKPPPGEAAREELRNGKLEEAPPPALPPPPRPVADKDTSNESSSGSATQNTKERPATELSTTEATTPAMPAPPLQPRALNPASRWSKIQIVTKQTGNECVTAIEIVPATPAGMRPAANVARKFASIARNQVRKKRQMAARERKVKRTIFAILLAFILTWTPYNVMVLVNTFCQSCIPDTVWSIGYWLCYVNSTINPACYALCNATFKKTFRHLLLCQYRNIGTAR

SEQ ID NO: 520 - DNA, 1599 bp, Homo sapiens
atggaaggggattcttaccacaatgcaaccaccgtcaatggcaccccagtaaatcaccagcctttggaacgccacaggttgtgggaagtcatcaccattgcagctgtgactgctgtggtaagcctgatcaccattgtgggcaatgtcttggtcatgatctccttcaaagtcaacagccagctcaagacagttaacaactattacctgctcagcttagcctgtgcagatctcatcattggaatcttctccatgaacctctacaccacctacatcctcatgggacgctgggctctcgggagtctggcttgtgacctttggcttgcactggactacgtggccagcaacgcttctgtcatgaaccttctggtgatcagttttgaccgttacttttccatcacaagacccttgacatatcgggccaagcgtactccgaaaagggctggcatcatgattggcttggcctggctgatctccttcatcctctgggccccagcaatcctctgctggcagtacttggttgggaagcggacagttccactggatgagtgccagatccagtttctctctgagcccaccatcacttttggcactgccattgctgccttctacatccctgtttctgtcatgaccatcctctactgtcgaatctaccgggaaacagagaagcgaaccaaggacctggctgacctccagggttctgactctgtgaccaaagctgagaagagaaagccagctcatagggctctgttcagatcctgcttgcgctgtcctcgacccaccctggcccagcgggaaaggaaccaggcctcctggtcatcctcccgcaggagcacctccaccactgggaagccatcccaagccactggcccaagcgccaattgggccaaagctgagcagctcaccacctgtagcagctacccttcctcagaggatgaggacaagcccgccactgaccctgtcctccaagtggtctacaagagtcagggtaaggaaagcccaggggaagaattcagtgctgaagagactgaggaaacttttgtgaaagctgaaactgaaaaaagtgactatgacaccccaaactaccttctgtctccagcagctgctcatagacccaagagtcagaaatgtgtggcctataagttccgattggtggtaaaagctgacgggaaccaggagaccaacaatggctgtcacaaggtgaaaatcatgccctgccccttcccagtggccaaggaaccttcaacgaaaggcctcaatcccaaccccagccatcaaatgaccaaacgaaagagagtggtcctagtcaaagagaggaaagcaaaacagacactgagtgccattctcctggccttcatcatcacatggaccccgtataacatcatggtcctggtttctaccttctgtgacaagtgtgtcccagtcaccctgtggcacttgggctattggttgtgctatgtcaatagcactgtcaaccccatctgctatgccctctgcaacagaaccttcaggaagacctttaagatgctgcttctctgccgatggaaaaagaaaaaagtggaagagaagttgtactggcaggggaacagcaagctaccctga

SEQ ID NO: 521 - protein, 532 aa, Homo sapiens
MEGDSYHNATTVNGTPVNHQPLERHRLWEVITIAAVTAVVSLITIVGNVLVMISFKVNSQLKTVNNYYLLSLACADLIIGIFSMNLYTTYILMGRWALGSLACDLWLALDYVASNASVMNLLVISFDRYFSITRPLTYRAKRTPKRAGIMIGLAWLISFILWAPAILCWQYLVGKRTVPLDECQIQFLSEPTITFGTAIAAFYIPVSVMTILYCRIYRETEKRTKDLADLQGSDSVTKAEKRKPAHRALFRSCLRCPRPTLAQRERNQASWSSSRRSTSTTGKPSQATGPSANWAKAEQLTTCSSYPSSEDEDKPATDPVLQVVYKSQGKESPGEEFSAEETEETFVKAETEKSDYDTPNYLLSPAAAHRPKSQKCVAYKFRLVVKADGNQETNNGCHKVKIMPCPFPVAKEPSTKGLNPNPSHQMTKRKRVVLVKERKAKQTLSAILLAFIITWTPYNIMVLVSTFCDKCVPVTLWHLGYWLCYVNSTVNPICYALCNRTFRKTFKMLLLCRWKKKKVEEKLYWQGNSKLP

SEQ ID NO: 522 - DNA, 972 bp, Homo sapiens
atgaatgcttcgtgctgcctgccctctgttcagccaacactgcctaatggctcggagcacctccaagcccctttcttcagcaaccagagcagcagcgccttctgtgagcaggtcttcatcaagcccgagattttcctgtctctgggcatcgtcagtctgctggaaaacatcctggttatcctggccgtggtcaggaacggcaacctgcactccccgatgtacttctttctctgcagcctggcggtggccgacatgctggtaagtgtgtccaatgccctggagaccatcatgatcgccatcgtccacagcgactacctgaccttcgaggaccagtttatccagcacatggacaacatcttcgactccatgatctgcatctccctggtggcctccatctgcaacctcctggccatcgccgtcgacaggtacgtcaccatcttttacgcgctccgctaccacagcatcatgaccgtgaggaaggccctcaccttgatcgtggccatctgggtctgctgcggcgtctgtggcgtggtgttcatcgtctactcggagagcaaaatggtcattgtgtgcctcatcaccatgttcttcgccatgatgctcctcatgggcaccctctacgtgcacatgttcctctttgcgcggctgcacgtcaagcgcatagcagcactgccacctgccgacggggtggccccacagcaacactcatgcatgaaggggaaagtcaccatcaccattctcctgggcgtgttcatcttctgctgggcccccttcttcctccacctggtcctcatcatcacctgccccaccaacccctactgcatctgctacactgcccacttcaacacctacctggtcctcatcatgtgcaactccgtcatcgacccactcatctacgctttccggagcctggaattgcgcaacacctttagggagattctctgtggctgcaacggcatgaacttgggatag

SEQ ID NO: 523 - protein, 323 aa, Homo sapiens
MNASCCLPSVQPTLPNGSEHLQAPFFSNQSSSAFCEQVFIKPEIFLSLGIVSLLENILVILAVVRNGNLHSPMYFFLCSLAVADMLVSVSNALETIMIAIVHSDYLTFEDQFIQHMDNIFDSMICISLVASICNLLAIAVDRYVTIFYALRYHSIMTVRKALTLIVAIWVCCGVCGVVFIVYSESKMVIVCLITMFFAMMLLMGTLYVHMFLFARLHVKRIAALPPADGVAPQQHSCMKGKVTITILLGVFIFCWAPFFLHLVLIITCPTNPYCICYTAHFNTYLVLIMCNSVIDPLIYAFRSLELRNTFREILCGCNGMNLG

SEQ ID NO: 524 - DNA, 1224 bp, Homo sapiens
atggataacgtcctcccggtggactcagacctctccccaaacatctccactaacacctcggaacccaatcagttcgtgcaaccagcctggcaaattgtcctttgggcagctgcctacacggtcattgtggtgacctctgtggtgggcaacgtggtagtgatgtggatcatcttagcccacaaaagaatgaggacagtgacgaactattttctggtgaacctggccttcgcggaggcctccatggctgcattcaatacagtggtgaacttcacctatgctgtccacaacgaatggtactacggcctgttctactgcaagttccacaacttctttcccatcgccgctgtcttcgccagtatctactccatgacggctgtggcctttgataggtacatggccatcatacatcccctccagccccggctgtcagccacagccaccaaagtggtcatctgtgtcatctgggtcctggctctcctgctggccttcccccagggctactactcaaccacagagaccatgcccagcagagtcgtgtgcatgatcgaatggccagagcatccgaacaagatttatgagaaagtgtaccacatctgtgtgactgtgctgatctacttcctccccctgctggtgattggctatgcatacaccgtagtgggaatcacactatgggccagtgagatccccggggactcctctgaccgctaccacgagcaagtctctgccaagcgcaaggtgaagaaaatgatgattgtcgtggtgtgcaccttcgccatctgctggctgcccttccacatcttcttcctcctgccctacatcaacccagatctctacctgaagaagtttatccagcaggtctacctggccatcatgtggctggccatgagctccaccatgtacaaccccatcatctactgctgcctcaatgacaggttccgtctgggcttcaagcatgccttccggtgctgccccttcatcagcgccggcgactatgaggggctggaaatgaaatccacccggtatctccagacccagggcagtgtgtacaaagtcagccgcctggagaccaccatctccacagtggtgggggcccacgaggaggagccagaggacggccccaaggccacaccctcgtccctggacctgacctccaactgctcttcacgaagtgactccaagaccatgacagagagcttcagcttctcctccaatgtgctctcctag

SEQ ID NO: 525 - protein, 407 aa, Homo sapiens
MDNVLPVDSDLSPNISTNTSEPNQFVQPAWQIVLWAAAYTVIVVTSVVGNVVVMWIILAHKRMRTVTNYFLVNLAFAEASMAAFNTVVNFTYAVHNEWYYGLFYCKFHNFFPIAAVFASIYSMTAVAFDRYMAIIHPLQPRLSATATKVVICVIWVLALLLAFPQGYYSTTETMPSRVVCMIEWPEHPNKIYEKVYHICVTVLIYFLPLLVIGYAYTVVGITLWASEIPGDSSDRYHEQVSAKRKVKKMMIVVVCTFAICWLPFHIFFLLPYINPDLYLKKFIQQVYLAIMWLAMSSTMYNPIIYCCLNDRFRLGFKHAFRCCPFISAGDYEGLEMKSTRYLQTQGSVYKVSRLETTISTVVGAHEEEPEDGPKATPSSLDLTSNCSSRSDSKTMTESFSFSSNVLS

SEQ ID NO: 526 - DNA, 1197 bp, Homo sapiens
atggggacctgtgacattgtgactgaagccaatatctcatctggccctgagagcaacaccacgggcatcacagccttctccatgcccagctggcagctggcactgtgggcaccagcctacctggccctggtgctggtggccgtgacgggtaatgccatcgtcatctggatcatcctggcccatcggaggatgcgcacagtcaccaactacttcatcgtcaatctggcgctggctgacctctgcatggctgccttcaatgccgccttcaactttgtctatgccagccacaacatctggtactttggccgtgccttctgctacttccagaacctcttccccatcacagccatgtttgtcagcatctactccatgaccgccattgctgccgacaggtacatggccatcgtccaccccttccagcctcggctttcagctcccagcaccaaggcggttattgctggcatctggctggtggctctcgccctggcctcccctcagtgcttctactccaccgtcaccatggaccagggtgccaccaagtgcgtggtggcctggcccgaagacagcgggggcaagacgctcctcctgtaccacctcgtggtgatcgccctcatctacttcctgccgctcgcggtgatgtttgtagcctacagcgtcatcggcctcacgctctggaggcgcgcagtgcccggacatcaggcgcacggtgccaacctccgccatctgcaggccaagaagaagtttaagaagaccatggtgctggtggtgctgacgtttgccatctgctggctgccctaccacctctacttcatcctgggcagcttccaggaggacatctactgccacaagttcatccagcaagtctacctggcactcttctggttggccatgagctctaccatgtacaatcccatcatctactgctgtctcaaccacaggtttcgctctgggttccggcttgccttccgctgctgcccatgggtcacacccaccaaggaagataagctcgagctgactcccacgacctccctctccacgagagtcaacaggtgtcacactaaggagactttgttcatggctggggacacagccccctccgaggctaccagtggggaggcggggcgtccccaggatggatcagggctatggtttgggtatggtttgcttgcccccaccaaaactcatgttgaaatttga

SEQ ID NO: 527 - protein, 398 aa, Homo sapiens
MGTCDIVTEANISSGPESNTTGITAFSMPSWQLALWAPAYLALVLVAVTGNAIVIWIILAHRRMRTVTNYFIVNLALADLCMAAFNAAFNFVYASHNIWYFGRAFCYFQNLFPITAMFVSIYSMTAIAADRYMAIVHPFQPRLSAPSTKAVIAGIWLVALALASPQCFYSTVTMDQGATKCVVAWPEDSGGKTLLLYHLVVIALIYFLPLAVMFVAYSVIGLTLWRRAVPGHQAHGANLRHLQAKKKFKKTMVLVVLTFAICWLPYHLYFILGSFQEDIYCHKFIQQVYLALFWLAMSSTMYNPIIYCCLNHRFRSGFRLAFRCCPWVTPTKEDKLELTPTTSLSTRVNRCHTKETLFMAGDTAPSEATSGEAGRPQDGSGLWFGYGLLAPTKTHVEI

SEQ ID NO: 528 - DNA, 1398 bp, Homo sapiens
atggccactctcccagcagcagaaacctggatagacgggggtggaggcgtgggtgcagacgccgtgaacctgaccgcctcgctagctgccggggcggccacgggggcagttgagactgggtggctgcaactgctggaccaagctggcaacctctcctcctccccttccgcgctgggactgcctgtggcttcccccgcgccctcccagccctgggccaacctcaccaaccagttcgtgcagccgtcctggcgcatcgcgctctggtccctggcgtatggtgtggtggtggcagtggcagttttgggaaatctcatcgtcatctggatcatcctggcccacaagcgcatgaggactgtcaccaactacttccttgtgaacctggctttctccgacgcctccatggccgccttcaacacgttggtcaatttcatctacgcgcttcatagcgagtggtactttggcgccaactactgccgcttccagaacttctttcctatcacagctgtgttcgccagcatctactccatgacggccattgcggtggacaggtatatggctattattgatcccttgaaacccagactgtctgctacagcaaccaagattgtcattggaagtatttggattctagcatttctacttgccttccctcagtgtctttattccaaaaccaaagtcatgccaggccgtactctctgctttgtgcaatggccagaaggtcccaaacaacatttcacttaccatattatcgtcattatactggtgtactgtttcccattgctcatcatgggtattacatacaccattgttggaattactctctggggaggagaaatcccaggagatacctgtgacaagtatcatgagcagctaaaggccaaaagaaaggttaagaaaatgatgattattgttgtcatgacatttgctatctgctggctgccctatcatatttacttcattctcactgcaatctatcaacaactaaatagatggaaatacatccagcaggtctacctggctagcttttggctggcaatgagctcaaccatgtacaatcccatcatctactgctgtctgaataaaagatttcgagctggcttcaagagagcatttcgctggtgtcctttcatcaaagtttccagctatgatgagctagagctcaagaccaccaggtttcatccaaaccggcaaagcagtatgtacaccgtgaccagaatggagtccatgacagtcgtgtttgaccccaacgatgcagacaccaccaggtccagtcggaagaaaagagcaacgccaagagacccaagtttcaatggctgctctcgcaggaattccaaatctgcctccgccacttcaagtttcataagctcaccctatacctctgtggatgaatattcttaa

SEQ ID NO: 529 - protein, 465 aa, Homo sapiens
MATLPAAETWIDGGGGVGADAVNLTASLAAGAATGAVETGWLQLLDQAGNLSSSPSALGLPVASPAPSQPWANLTNQFVQPSWRIALWSLAYGVVVAVAVLGNLIVIWIILAHKRMRTVTNYFLVNLAFSDASMAAFNTLVNFIYALHSEWYFGANYCRFQNFFPITAVFASIYSMTAIAVDRYMAIIDPLKPRLSATATKIVIGSIWILAFLLAFPQCLYSKTKVMPGRTLCFVQWPEGPKQHFTYHIIVIILVYCFPLLIMGITYTIVGITLWGGEIPGDTCDKYHEQLKAKRKVKKMMIIVVMTFAICWLPYHIYFILTAIYQQLNRWKYIQQVYLASFWLAMSSTMYNPIIYCCLNKRFRAGFKRAFRWCPFIKVSSYDELELKTTRFHPNRQSSMYTVTRMESMTVVFDPNDADTTRSSRKKRATPRDPSFNGCSRRNSKSASATSSFISSPYTSVDEYS

SEQ ID NO: 530 - DNA, 1173 bp, Homo sapiens
atgccctctaagtctctttccaacctctcggtgaccaccggcgcgaatgagagcggttccgttcccgaggggtgggaaagggatttcctgccggcctcggacgggaccaccacggagttggtgatccgctgtgtgatcccgtccctctacctgctcatcatcaccgtgggcttgctgggcaacatcatgctggtgaagatcttcatcaccaacagcgccatgaggagcgtccccaacatcttcatctctaacctggcggccggggacttgctgctgctgctcacctgcgtcccggtggacgcctcgcgctacttcttcgacgagtggatgtttggcaaggtgggctgcaaactgatccctgtcatccagctcacttccgtgggggtttccgtgttcactctcactgccctcagcgccgacaggtacagagccatcgttaaccccatggacatgcagacgtcaggggcattgctgcggacctgtgtgaaggccatgggtatctgggtggtctccgtgttgctggcagttcccgaagcggtgttttcagaagtggctcgcatcagtagcttggataatagcagcttcacagcatgtatcccataccctcaaacagatgaattacatccaaagattcattcagtgctcattttcttggtctatttcctcataccacttgctattattagcatttattattatcatattgcaaagaccttaattaaaagcgcacacaatcttcctggagaatacaatgaacataccaaaaaacagatggaaacacggaaacgcctgaaaaaaattgtgcttgtctttgtgggctgtttcatcttctgttggtttccaaaccacatcctttacatgtatcggtctttcaactataatgagattgatccatctctaggccacatgattgtcaccttagttgcccgggttctcagttttggcaattcttgtgtcaacccatttgctctttacctactcagtgaaagcttcaggaggcatttcaacagccaactctgctgtgggaggaagtcctatcaagagagaggaaccagctacctactcagctcttcagcggtgcgtatgacatctctgaaaagcaatgctaagaacatggtgaccaattctgttttactaaatgggcacagcatgaagcaggaaatggcaatgtga

SEQ ID NO: 531 - protein, 390 aa, Homo sapiens
MPSKSLSNLSVTTGANESGSVPEGWERDFLPASDGTTTELVIRCVIPSLYLLIITVGLLGNIMLVKIFITNSAMRSVPNIFISNLAAGDLLLLLTCVPVDASRYFFDEWMFGKVGCKLIPVIQLTSVGVSVFTLTALSADRYRAIVNPMDMQTSGALLRTCVKAMGIWVVSVLLAVPEAVFSEVARISSLDNSSFTACIPYPQTDELHPKIHSVLIFLVYFLIPLAIISIYYYHIAKTLIKSAHNLPGEYNEHTKKQMETRKRLKKIVLVFVGCFIFCWFPNHILYMYRSFNYNEIDPSLGHMIVTLVARVLSFGNSCVNPFALYLLSESFRRHFNSQLCCGRKSYQERGTSYLLSSSAVRMTSLKSNAKNMVTNSVLLNGHSMKQEMAM

SEQ ID NO: 532 - DNA, 1338 bp, Homo sapiens
atggatttagagctcgacgagtattataacaagacacttgccacagagaataatactgctgccactcggaattctgatttcccagtctgggatgactataaaagcagtgtagatgacttacagtattttctgattgggctctatacatttgtaagtcttcttggctttatggggaatctacttattttaatggctctcatgaaaaagcgtaatcagaagactacggtaaacttcctcataggcaatctggccttttctgatatcttggttgtgctgttttgctcacctttcacactgacgtctgtcttgctggatcagtggatgtttggcaaagtcatgtgccatattatgccttttcttcaatgtgtgtcagttttggtttcaactttaattttaatatcaattgccattgtcaggtatcatatgataaaacatcccatatctaataatttaacagcaaaccatggctactttctgatagctactgtctggacactaggttttgccatctgttctccccttccagtgtttcacagtcttgtggaacttcaagaaacatttggttcagcattgctgagcagcaggtatttatgtgttgagtcatggccatctgattcatacagaattgcctttactatctctttattgctagttcagtatattctgcccttagtttgtcttactgtaagtcatacaagtgtctgcagaagtataagctgtggattgtccaacaaagaaaacagacttgaagaaaatgagatgatcaacttaactcttcatccatccaaaaagagtgggcctcaggtgaaactctctggcagccataaatggagttattcattcatcaaaaaacacagaagaagatatagcaagaagacagcatgtgtgttacctgctccagaaagaccttctcaagagaaccactccagaatacttccagaaaactttggctctgtaagaagtcagctctcttcatccagtaagttcataccaggggtccccacttgctttgagataaaacctgaagaaaattcagatgttcatgaattgagagtaaaacgttctgttacaagaataaaaaagagatctcgaagtgttaagtacagactgaccatactgatattagtatttgctgttagttggatgccactacaccttttccatgtggtaactgattttaatgacaatcttatttcaaataggcatttcaagttggtgtattgcatttgtcatttgttgggcatgatgtcctgttgtcttaatccaattctatatgggtttcttaataatgggattaaagctgatttagtgtcccttatacactgtcttcatatgtaa

SEQ ID NO: 533 - protein, 445 aa, Homo sapiens
MDLELDEYYNKTLATENNTAATRNSDFPVWDDYKSSVDDLQYFLIGLYTFVSLLGFMGNLLILMALMKKRNQKTTVNFLIGNLAFSDILVVLFCSPFTLTSVLLDQWMFGKVMCHIMPFLQCVSVLVSTLILISIAIVRYHMIKHPISNNLTANHGYFLIATVWTLGFAICSPLPVFHSLVELQETFGSALLSSRYLCVESWPSDSYRIAFTISLLLVQYILPLVCLTVSHTSVCRSISCGLSNKENRLEENEMINLTLHPSKKSGPQVKLSGSHKWSYSFIKKHRRRYSKKTACVLPAPERPSQENHSRILPENFGSVRSQLSSSSKFIPGVPTCFEIKPEENSDVHELRVKRSVTRIKKRSRSVKYRLTILILVFAVSWMPLHLFHVVTDFNDNLISNRHFKLVYCICHLLGMMSCCLNPILYGFLNNGIKADLVSLIHCLHM

SEQ ID NO: 534 - DNA, 1257 bp, Homo sapiens
atgcgcctcaacagctccgcgccgggaaccccgggcacgccggccgccgaccccttccagcgggcgcaggccggactggaggaggcgctgctggccccgggcttcggcaacgcttcgggcaacgcgtcggagcgcgtcctggcggcacccagcagcgagctggacgtgaacaccgacatctactccaaagtgctggtgaccgccgtgtacctggcgctcttcgtggtgggcacggtgggcaacacggtgacggcgttcacgctggcgcggaagaagtcgctgcagagcctgcagagcacggtgcattaccacctgggcagcctggcgctgtccgacctgctcaccctgctgctggccatgcccgtggagctgtacaacttcatctgggtgcaccacccctgggccttcggcgacgccggctgccgcggctactacttcctgcgcgacgcctgcacctacgccacggccctcaacgtggccagcctgagtgtggagcgctacctggccatctgccaccccttcaaggccaagaccctcatgtcccgaagccgcaccaagaagttcatcagcgccatctggctcgcctcggccctgctgacggtgcctatgctgttcaccatgggcgagcagaaccgcagcgccgacggccagcacgccggcggcctggtgtgcacccccaccatccacactgccaccgtcaaggtcgtcatacaggtcaacaccttcatgtccttcatattccccatggtggtcatctcggtcctgaacaccatcatcgccaacaagctgaccgtcatggtacgccaggcggccgagcagggccaagtgtgcacggtcgggggcgagcacagcacattcagcatggccatcgagcctggcagggtccaggccctgcggcacggcaagcgcgtcctacgtgcagtggtcatcgcctttgtggtctgctggctgccctaccacgtgcggcgcctcatgttctgctacatctcggatgagcagtggactccgttcctctatgacttctaccactacttctacatggtgaccaacgcactcttctacgtcagctccaccatcaaccccatcctgtacaacctcgtctctgccaacttccgccacatcttcctggccacactggcctgcctctgcccggtgtggcggcgcaggaggaagaggccagccttctcgaggaaggccgacagcgtgtccagcaaccacaccctctccagcaatgccacccgcgagacgctgtactag

SEQ ID NO: 535 - protein, 418 aa, Homo sapiens
MRLNSSAPGTPGTPAADPFQRAQAGLEEALLAPGFGNASGNASERVLAAPSSELDVNTDIYSKVLVTAVYLALFVVGTVGNTVTAFTLARKKSLQSLQSTVHYHLGSLALSDLLTLLLAMPVELYNFIWVHHPWAFGDAGCRGYYFLRDACTYATALNVASLSVERYLAICHPFKAKTLMSRSRTKKFISAIWLASALLTVPMLFTMGEQNRSADGQHAGGLVCTPTIHTATVKVVIQVNTFMSFIFPMVVISVLNTIIANKLTVMVRQAAEQGQVCTVGGEHSTFSMAIEPGRVQALRHGKRVLRAVVIAFVVCWLPYHVRRLMFCYISDEQWTPFLYDFYHYFYMVTNALFYVSSTINPILYNLVSANFRHIFLATLACLCPVWRRRRKRPAFSRKADSVSSNHTLSSNATRETLY

SEQ ID NO: 536 - DNA, 1233 bp, Homo sapiens
atggaaaccagcagcccgcggcccccgcggcccagctccaacccggggctgagcctggacgcccggctgggcgtggacactcgcctctgggccaaggtgctgttcaccgcgctctacgcactcatctgggcgctgggcgcggcgggcaatgcgctgtccgtgcacgtggtgctgaaggcgcgggccgggcgcgcggggcgcctgcgccaccacgtgctcagcctggcgctcgcgggcctgctgctgctgctggtcggcgtgccggtggagctctacagcttcgtgtggttccactacccctgggtcttcggcgacctgggctgccgcggctactacttcgtgcacgagctgtgcgcctacgccacggtgctgagcgtggcaggcctgagcgccgagcgctgcctagccgtgtgccagcccctgcgtgcccgcagcctgctgacgccacgccggacccggtggctggtggcgctctcgtgggccgcctcgctcggcctcgccctgcccatggccgtcatcatggggcagaagcacgaactcgagacggcggacggggagccggagcccgcctcgcgagtgtgcacggtgctggtgagccgcaccgcgctccaagtctttatccaggtgaatgtgctggtgtccttcgtgctccccttggcactaactgctttcctgaatggggtcacagtgagccacctgctggccctctgctcccaagtgccgtccacttctaccccgggcagctccacccccagccgcctggagctgctgagtgaggagggtctcctcagcttcatcgtatggaagaagacctttatccagggaggccaggtcagcctggtgagacataaagacgtgcgccggatccgcagcctccagcgcagcaagcaggttctcagagccatcgtggtcatgtatgtcatctgctggctgccgtaccatgcccgcaggctcatgtactgctacgtacctgatgacgcgtggactgacccactgtacaatttctaccactacttctacatggtgaccaacacacttttctacgtcagctcagctgtgactcctcttctctacaacgccgtgtcctcctccttcagaaaactcttcctggaagccgtcagctccctgtgtggagagcaccaccccatgaagcggttacccccgaagccccagagtcccaccctaatggatacagcttcaggctttggggatcccccagaaacccggacctga

SEQ ID NO: 537 - protein, 410 aa, Homo sapiens
METSSPRPPRPSSNPGLSLDARLGVDTRLWAKVLFTALYALIWALGAAGNALSVHVVLKARAGRAGRLRHHVLSLALAGLLLLLVGVPVELYSFVWFHYPWVFGDLGCRGYYFVHELCAYATVLSVAGLSAERCLAVCQPLRARSLLTPRRTRWLVALSWAASLGLALPMAVIMGQKHELETADGEPEPASRVCTVLVSRTALQVFIQVNVLVSFVLPLALTAFLNGVTVSHLLALCSQVPSTSTPGSSTPSRLELLSEEGLLSFIVWKKTFIQGGQVSLVRHKDVRRIRSLQRSKQVLRAIVVMYVICWLPYHARRLMYCYVPDDAWTDPLYNFYHYFYMVTNTLFYVSSAVTPLLYNAVSSSFRKLFLEAVSSLCGEHHPMKRLPPKPQSPTLMDTASGFGDPPETRT

SEQ ID NO: 538 - DNA, 1119 bp, Homo sapiens
atggaaccggccccctccgccggcgccgagctgcagcccccgctcttcgccaacgcctcggacgcctaccctagcgccttccccagcgctggcgccaatgcgtcggggccgccaggaccggggagcgcctcgtccctcgccctggcaatcgccatcaccgcgctctactcggccgtgtgcgccgtggggctgctgggcaacgtgcttgtcatgttcggcatcgtccggtacactaagatgaagacggccaccaacatctacatcttcaacctggccttagccgatgcgctggccaccagcacgctgcctttccagagtgccaagtacctgatggagacgtggcccttcggcgagctgctctgcaaggctgtgctctccatcgactactacaatatgttcaccagcatcttcacgctcaccatgatgagtgttgaccgctacatcgctgtctgccaccctgtcaaggccctggacttccgcacgcctgccaaggccaagctgatcaacatctgtatctgggtcctggcctcaggcgttggcgtgcccatcatggtcatggctgtgacccgtccccgggacggtgcagtggtgtgcatgctccagttccccagccccagctggtactgggacacggtgaccaagatctgcgtgttcctcttcgccttcgtggtgcccatcctcatcatcaccgtgtgctatggcctcatgctgctgcgcctgcgcagtgtgcgcctgctgtcgggctccaaggagaaggaccgcagcctgcggcgcatcaagcgcatggtgctggtggttgtgggcgccttcgtggtgtgttgggcgcccatccacatcttcgtcatcgtctggacgctggtggacatcgaccggcgcgacccgctggtggtggctgcgctgcacctgtgcatcgcgctgggctacgccaatagcagcctcaaccccgtgctctacgctttcctcgacgagaacttcaagcgctgcttccgccagctctgccgcaagccctgcggccgcccagaccccagcagcttcagccggccccgcgaagccacggcccgcgagcgtgtcaccgcctgcaccccgtccgatggtcccggcggtggccgtgccgcctga

SEQ ID NO: 539 - protein, 372 aa, Homo sapiens
MEPAPSAGAELQPPLFANASDAYPSAFPSAGANASGPPGPGSASSLALAIAITALYSAVCAVGLLGNVLVMFGIVRYTKMKTATNIYIFNLALADALATSTLPFQSAKYLMETWPFGELLCKAVLSIDYYNMFTSIFTLTMMSVDRYIAVCHPVKALDFRTPAKAKLINICIWVLASGVGVPIMVMAVTRPRDGAVVCMLQFPSPSWYWDTVTKICVFLFAFVVPILIITVCYGLMLLRLRSVRLLSGSKEKDRSLRRIKRMVLVVVGAFVVCWAPIHIFVIVWTLVDIDRRDPLVVAALHLCIALGYANSSLNPVLYAFLDENFKRCFRQLCRKPCGRPDPSSFSRPREATARERVTACTPSDGPGGGRAA

SEQ ID NO: 540 - DNA, 1113 bp, Homo sapiens
atggagcccctcttccccgcgccgttctgggaggttatctacggcagccaccttcagggcaacctgtccctcctgagccccaaccacagtctgctgcccccgcatctgctgctcaatgccagccacggcgccttcctgcccctcgggctcaaggtcaccatcgtggggctctacctggccgtgtgtgtcggagggctcctggggaactgccttgtcatgtacgtcatcctcaggcacaccaaaatgaagacagccaccaatatttacatctttaacctggccctggccgacactctggtcctgctgacgctgcccttccagggcacggacatcctcctgggcttctggccgtttgggaatgcgctgtgcaagacagtcattgccattgactactacaacatgttcaccagcaccttcaccctaactgccatgagtgtggatcgctatgtagccatctgccaccccatccgtgccctcgacgtccgcacgtccagcaaagcccaggctgtcaatgtggccatctgggccctggcctctgttgtcggtgttcccgttgccatcatgggctcggcacaggtcgaggatgaagagatcgagtgcctggtggagatccctacccctcaggattactggggcccggtgtttgccatctgcatcttcctcttctccttcatcgtccccgtgctcgtcatctctgtctgctacagcctcatgatccggcggctccgtggagtccgcctgctctcgggctcccgagagaaggaccggaacctgcggcgcatcaagcggctggtgctggtggtagtggctgtgttcgtgggctgctggacgcctgtccaggtcttcgtgctggcccaagggctgggggttcagccgagcagcgagactgccgtggccattctgcgcttctgcacggccctgggctacgtcaacagctgcctcaaccccatcctctacgccttcctggatgagaacttcaaggcctgcttccgcaagttctgctgtgcatctgccctgcgccgggacgtgcaggtgtctgaccgcgtgcgcagcattgccaaggacgtggccctggcctgcaagacctctgagacggtaccgcggcccgcatga

SEQ ID NO: 541 - protein, 370 aa, Homo sapiens
MEPLFPAPFWEVIYGSHLQGNLSLLSPNHSLLPPHLLLNASHGAFLPLGLKVTIVGLYLAVCVGGLLGNCLVMYVILRHTKMKTATNIYIFNLALADTLVLLTLPFQGTDILLGFWPFGNALCKTVIAIDYYNMFTSTFTLTAMSVDRYVAICHPIRALDVRTSSKAQAVNVAIWALASVVGVPVAIMGSAQVEDEEIECLVEIPTPQDYWGPVFAICIFLFSFIVPVLVISVCYSLMIRRLRGVRLLSGSREKDRNLRRIKRLVLVVVAVFVGCWTPVQVFVLAQGLGVQPSSETAVAILRFCTALGYVNSCLNPILYAFLDENFKACFRKFCCASALRRDVQVSDRVRSIAKDVALACKTSETVPRPA

SEQ ID NO: 542 - DNA, 1143 bp, Homo sapiens
atggaatccccgattcagatcttccgcggggagcctggccctacctgcgccccgagcgcctgcctgccccccaacagcagcgcctggtttcccggctgggccgagcccgacagcaacggcagcgccggctcggaggacgcgcagctggagcccgcgcacatctccccggccatcccggtcatcatcacggcggtctactccgtagtgttcgtcgtgggcttggtgggcaactcgctggtcatgttcgtgatcatccgatacacaaagatgaagacagcaaccaacatttacatatttaacctggctttggcagatgctttagttactacaaccatgccctttcagagtacggtctacttgatgaattcctggccttttggggatgtgctgtgcaagatagtaatttccattgattactacaacatgttcaccagcatcttcaccttgaccatgatgagcgtggaccgctacattgccgtgtgccaccccgtgaaggctttggacttccgcacacccttgaaggcaaagatcatcaatatctgcatctggctgctgtcgtcatctgttggcatctctgcaatagtccttggaggcaccaaagtcagggaagacgtcgatgtcattgagtgctccttgcagttcccagatgatgactactcctggtgggacctcttcatgaagatctgcgtcttcatctttgccttcgtgatccctgtcctcatcatcatcgtctgctacaccctgatgatcctgcgtctcaagagcgtccggctcctttctggctcccgagagaaagatcgcaacctgcgtaggatcaagagactggtcctggtggtggtggcggttttcgtcgtctgctggactcccattcacatattcatcctggtggaggctctggggagcacctcccacagcacagctgctctctccagctattacttctgcatcgccttaggctataccaacagtagcctgaatcccattctctacgcctttcttgatgaaaacttcaagcggtgtttccgggacttctgctttccactgaagatgaggatggagcggcagagcactagcagagtccgaaatacagttcaggatcctgcttacctgagggacatcgatgggatgaataaaccagtatga

SEQ ID NO: 543 - protein, 380 aa, Homo sapiens
MESPIQIFRGEPGPTCAPSACLPPNSSAWFPGWAEPDSNGSAGSEDAQLEPAHISPAIPVIITAVYSVVFVVGLVGNSLVMFVIIRYTKMKTATNIYIFNLALADALVTTTMPFQSTVYLMNSWPFGDVLCKIVISIDYYNMFTSIFTLTMMSVDRYIAVCHPVKALDFRTPLKAKIINICIWLLSSSVGISAIVLGGTKVREDVDVIECSLQFPDDDYSWWDLFMKICVFIFAFVIPVLIIIVCYTLMILRLKSVRLLSGSREKDRNLRRIKRLVLVVVAVFVVCWTPIHIFILVEALGSTSHSTAALSSYYFCIALGYTNSSLNPILYAFLDENFKRCFRDFCFPLKMRMERQSTSRVRNTVQDPAYLRDIDGMNKPV

SEQ ID NO: 544 - DNA, 1203 bp, Homo sapiens
atggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccaacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctcgtgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaagaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagctagaaaatctggaagcagaaactgctccgttgccctaa

SEQ ID NO: 545 - protein, 400 aa, Homo sapiens
MDSSAAPTNASNCTDALAYSSCSPAPSPGSWVNLSHLDGNLSDPCGPNRTNLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLVKICVFIFAFIMPVLIITVCYGLMILRLKSVRMLSGSKEKDRNLRRIKRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQLENLEAETAPLP

SEQ ID NO: 546 - DNA, 1182 bp, Homo sapiens
atggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccaacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctcgtgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaagaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagctagtacgcagtctctag

SEQ ID NO: 547 - protein, 392 aa, Homo sapiens
MDSSAAPTNASNCTDALAYSSCSPAPSPGSWVNLSHLDGNLSDPCGPNRTNLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLVKICVFIFAFIMPVLIITVCYGLMILRLKSVRMLSGSKEKDRNLRRIKRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQVRSL

SEQ ID NO: 548 - DNA, 1278 bp, Homo sapiens
atggagccctcagccaccccaggggcccagatgggggtcccccctggcagcagagagccgtcccctgtgcctccagactatgaagatgagtttctccgctatctgtggcgtgattatctgtacccaaaacagtatgagtgggtcctcatcgcagcctatgtggctgtgttcgtcgtggccctggtgggcaacacgctggtctgcctggccgtgtggcggaaccaccacatgaggacagtcaccaactacttcattgtcaacctgtccctggctgacgttctggtgactgctatctgcctgccggccagcctgctggtggacatcactgagtcctggctgttcggccatgccctctgcaaggtcatcccctatctacaggctgtgtccgtgtcagtggcagtgctaactctcagcttcatcgccctggaccgctggtatgccatctgccacccactattgttcaagagcacagcccggcgggcccgtggctccatcctgggcatctgggctgtgtcgctggccatcatggtgccccaggctgcagtcatggaatgcagcagtgtgctgcctgagctagccaaccgcacacggctcttctcagtctgtgatgaacgctgggcagatgacctctatcccaagatctaccacagttgcttctttattgtcacctacctggccccactgggcctcatggccatggcctatttccagatattccgcaagctctggggccgccagatccccggcaccacctcagcactggtgcggaactggaagcgcccctcagaccagctgggggacctggagcagggcctgagtggagagccccagccccggggccgcgccttcctggctgaagtgaagcagatgcgtgcacggaggaagacaaaaaagatgctgatggtggtgctgctggtcttcgccctctgctacctgcccatcagcgtcctcaatgtccttaagagggtgttcgggatgttccgccaagccagtgaccgcgaagctgtctacgcctgcttcaccttctcccactggctggtgtacgccaacagcgctgccaaccccatcatctacaacttcctcagtggcaaattccgggagcagtttaaggctgccttctcctgctgcctgcctggcctgggtccctgcggctctctgaaggcccctagtccccgctcctctgccagccacaagtccttgtccttgcagagccgatgctccatctccaaaatctctgagcatgtggtgctcaccagcgtcaccacagtgctgccctga

SEQ ID NO: 549 - protein, 425 aa, Homo sapiens
MEPSATPGAQMGVPPGSREPSPVPPDYEDEFLRYLWRDYLYPKQYEWVLIAAYVAVFVVALVGNTLVCLAVWRNHHMRTVTNYFIVNLSLADVLVTAICLPASLLVDITESWLFGHALCKVIPYLQAVSVSVAVLTLSFIALDRWYAICHPLLFKSTARRARGSILGIWAVSLAIMVPQAAVMECSSVLPELANRTRLFSVCDERWADDLYPKIYHSCFFIVTYLAPLGLMAMAYFQIFRKLWGRQIPGTTSALVRNWKRPSDQLGDLEQGLSGEPQPRGRAFLAEVKQMRARRKTKKMLMVVLLVFALCYLPISVLNVLKRVFGMFRQASDREAVYACFTFSHWLVYANSAANPIIYNFLSGKFREQFKAAFSCCLPGLGPCGSLKAPSPRSSASHKSLSLQSRCSISKISEHVVLTSVTTVLP

SEQ ID NO: 550 - DNA, 1335 bp, Homo sapiens
atgtccggcaccaaattggaggactcccccccttgtcgcaactggtcatctgcttcggagctgaatgaaactcaagagccctttttaaaccccaccgactatgacgacgaggaattcctgcggtacctgtggagggaatacctgcacccgaaagaatatgagtgggtcctgatcgccgggtacatcatcgtgttcgtcgtggctctcattgggaacgtcctggtttgtgtggcagtgtggaagaaccaccacatgaggacggtaaccaactacttcatagtcaatctttctctggctgatgtgctcgtgaccatcacctgccttccagccacactggtcgtggatatcactgagacctggttttttggacagtccctttgcaaagtgattccttatctacagaccgtgtcggtgtctgtgtctgtcctcacactgagctgtatcgccttggatcggtggtatgcaatctgtcaccctttgatgtttaagagcacagcaaagcgggcccgtaacagcattgtcatcatctggattgtctcctgcattataatgattcctcaggccatcgtcatggagtgcagcaccgtgttcccaggcttagccaataaaaccaccctctttacggtgtgtgatgagcgctggggtggtgaaatttatcccaagatgtaccacatctgtttctttctggtgacatacatggcaccactgtgtctcatggtgttggcttatctgcaaatatttcgcaaactctggtgtcgacagatccctggaacatcatctgtagttcagagaaaatggaagcccctgcagcctgtttcacagcctcgagggccaggacagccaacgaagtcccggatgagcgctgtggcggctgaaataaagcagatccgagccagaaggaaaacaaaacggatgttgatggttgtgcttttggtatttgcaatttgctatctaccaattagcatcctcaatgtgctaaagagagtatttgggatgtttgcccatactgaagacagagagactgtgtatgcctggtttaccttttcacactggcttgtatatgccaatagtgctgcgaatccaattatttataattttctcagtggaaaatttcgagaggaatttaaagctgcgttttcttgctgttgccttggagttcaccatcgccaggaggatcggctcaccaggggacgaactagcacagagagccggaagtccttgaccactcaaatcagcaactttgataacatatcaaaactttctgagcaagttgtgctcactagcataagcacactcccagcagccaatggagcaggaccacttcaaaactggtag

SEQ ID NO: 551 - protein, 444 aa, Homo sapiens
MSGTKLEDSPPCRNWSSASELNETQEPFLNPTDYDDEEFLRYLWREYLHPKEYEWVLIAGYIIVFVVALIGNVLVCVAVWKNHHMRTVTNYFIVNLSLADVLVTITCLPATLVVDITETWFFGQSLCKVIPYLQTVSVSVSVLTLSCIALDRWYAICHPLMFKSTAKRARNSIVIIWIVSCIIMIPQAIVMECSTVFPGLANKTTLFTVCDERWGGEIYPKMYHICFFLVTYMAPLCLMVLAYLQIFRKLWCRQIPGTSSVVQRKWKPLQPVSQPRGPGQPTKSRMSAVAAEIKQIRARRKTKRMLMVVLLVFAICYLPISILNVLKRVFGMFAHTEDRETVYAWFTFSHWLVYANSAANPIIYNFLSGKFREEFKAAFSCCCLGVHHRQEDRLTRGRTSTESRKSLTTQISNFDNISKLSEQVVLTSISTLPAANGAGPLQNW

SEQ ID NO: 552 - DNA, 1407 bp, Homo sapiens
atggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctggtcagctgccctgagctcttccgaatcttcaacccagaccaagtctgggagaccgaaaccattggagagtctgattttggtgacagtaactccttagatctctcagacatgggagtggtgagccggaactgcacggaggatggctggtcggaacccttccctcattactttgatgcctgtgggtttgatgaatatgaatctgagactggggaccaggattattactacctgtcagtgaaggccctctacacggttggctacagcacatccctcgtcaccctcaccactgccatggtcatcctttgtcgcttccggaagctgcactgcacacgcaacttcatccacatgaacctgtttgtgtcgttcatgctgagggcgatctccgtcttcatcaaagactggattctgtatgcggagcaggacagcaaccactgcttcatctccactgtggaatgtaaggccgtcatggttttcttccactactgtgttgtgtccaactacttctggctgttcatcgagggcctgtacctcttcactctgctggtggagaccttcttccctgaaaggagatacttctactggtacaccatcattggctgggggaccccaactgtgtgtgtgacagtgtgggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttgcgactggcccggtcccccctgctgctcatcccactattcggaatccactacacagtatttgccttctccccagagaatgtcagcaaaagggaaagactcgtgtttgagctggggctgggctccttccagggctttgtggtggctgttctctactgttttctgaatggtgaggtacaagcggagatcaagcgaaaatggcgaagctggaaggtgaaccgttacttcgctgtggacttcaagcaccgacacccgtctctggccagcagtggggtgaatgggggcacccagctctccatcctgagcaagagcagctcccaaatccgcatgtctggcctccctgctgacaatctggccacctga

SEQ ID NO: 553 - protein, 468 aa, Homo sapiens
MAGVVHVSLAALLLLPMAPAMHSDCIFKKEQAMCLEKIQRANELMGFNDSSPGCPGMWDNITCWKPAHVGEMVLVSCPELFRIFNPDQVWETETIGESDFGDSNSLDLSDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYLRLARSPLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 554 - DNA, 1029 bp, Homo sapiens
atggagccacatgactcctcccacatggactctgagttccgatacactctcttcccgattgtttacagcatcatctttgtgctcggggtcattgctaatggctacgtgctgtgggtctttgcccgcctgtacccttgcaagaaattcaatgagataaagatcttcatggtgaacctcaccatggcggacatgctcttcttgatcaccctgccactttggattgtctactaccaaaaccagggcaactggatactccccaaattcctgtgcaacgtggctggctgccttttcttcatcaacacctactgctctgtggccttcctgggcgtcatcacttataaccgcttccaggcagtaactcggcccatcaagactgctcaggccaacacccgcaagcgtggcatctctttgtccttggtcatctgggtggccattgtgggagctgcatcctacttcctcatcctggactccaccaacacagtgcccgacagtgctggctcaggcaacgtcactcgctgctttgagcattacgagaagggcagcgtgccagtcctcatcatccacatcttcatcgtgttcagcttcttcctggtcttcctcatcatcctcttctgcaacctggtcatcatccgtaccttgctcatgcagccggtgcagcagcagcgcaacgctgaagtcaagcgccgggcgaagtggatggtgtgcacggtcttggcggtgttcatcatctgcttcgtgccccaccacgtggtgcagctgccctggacccttgctgagctgggcttccaggacagcaaattccaccaggccattaatgatgcacatcaggtcaccctctgcctccttagcaccaactgtgtcttagaccctgttatctactgtttcctcaccaagaagttccgcaagcacctcaccgaaaagttctacagcatgcgcagtagccggaaatgctcccgggccaccacggatacggtcactgaagtggttgtgccattcaaccagatccctggcaattccctcaaaaattag

SEQ ID NO: 555 - protein, 342 aa, Homo sapiens
MEPHDSSHMDSEFRYTLFPIVYSIIFVLGVIANGYVLWVFARLYPCKKFNEIKIFMVNLTMADMLFLITLPLWIVYYQNQGNWILPKFLCNVAGCLFFINTYCSVAFLGVITYNRFQAVTRPIKTAQANTRKRGISLSLVIWVAIVGAASYFLILDSTNTVPDSAGSGNVTRCFEHYEKGSVPVLIIHIFIVFSFFLVFLIILFCNLVIIRTLLMQPVQQQRNAEVKRRAKWMVCTVLAVFIICFVPHHVVQLPWTLAELGFQDSKFHQAINDAHQVTLCLLSTNCVLDPVIYCFLTKKFRKHLTEKFYSMRSSRKCSRATTDTVTEVVVPFNQIPGNSLKN

SEQ ID NO: 556 - DNA, 1209 bp, Homo sapiens
atgagcccttgcgggcccctcaacctgagcctggcgggcgaggcgaccacatgcgcggcgccctgggtccccaacacgtcggccgtgccgccgtcgggcgcttcgcccgcgctgcccatcttctccatgacgctgggcgccgtgtccaacctgctggcgctggcgctgctggcgcaggccgcgggccgcctgcgacgccgccgctcggccaccaccttcctgctgttcgtggccagcctgctggccaccgacctggcgggccacgtgatcccgggcgcgctggtgctgcgtctgtacactgcggggcgcgctccggccggcggggcctgccacttcctgggcggctgcatggtcttcttcggcctgtgcccgctgctgctgggctgtggcatggccgtggagcgctgcgtgggcgtcacgcggccgctgctccacgccgcgcgggtctcggtcgcccgcgcgcgcctggcgctggccgcggtggccgcggtggccttggccgtggcgctgctgccgctggcgcgcgtgggccgctatgagctgcagtacccgggcacgtggtgcttcatcggcctgggtcccccgggcggctggcgccaggcactgcttgctggcctcttcgccagcctcggcctggtcgcgctcctcgccgcgctggtgtgcaacacgctcagcggcctggccctgcatcgcgcccgctggcgacgccgctcccgacggcctcccccggcctcaggccccgacagccggcgtcgctggggggcgcacggaccccgctcggcctccgcctcgtccgcctcgtccatcgcttcggcctccaccttctttggcggctctcggagcagcggctcggcacgcagagctcgcgcccacgacgtggagatgaagggccagcttgtcggtatcatggtggtgtcgtgcatctgctggagcccaatgctggtgttggtggcgctggccgtcggcggctggagctctacctccctgcagcggccactgttcctggccgtgcgccttgcctcctggaaccagatcctggacccttgggtgtacatcctactgcgccaggccgtgctgcgccaactgcttcgcctcttgcccccgagggccggagccaagggcggccccgcggggctgggcctaacaccgagcgcctgggaggccagctcgctgcgcagctcccggcacagcggcctcagccacttctaa

SEQ ID NO: 557 - protein, 402 aa, Homo sapiens
MSPCGPLNLSLAGEATTCAAPWVPNTSAVPPSGASPALPIFSMTLGAVSNLLALALLAQAAGRLRRRRSATTFLLFVASLLATDLAGHVIPGALVLRLYTAGRAPAGGACHFLGGCMVFFGLCPLLLGCGMAVERCVGVTRPLLHAARVSVARARLALAAVAAVALAVALLPLARVGRYELQYPGTWCFIGLGPPGGWRQALLAGLFASLGLVALLAALVCNTLSGLALHRARWRRRSRRPPPASGPDSRRRWGAHGPRSASASSASSIASASTFFGGSRSSGSARRARAHDVEMKGQLVGIMVVSCICWSPMLVLVALAVGGWSSTSLQRPLFLAVRLASWNQILDPWVYILLRQAVLRQLLRLLPPRAGAKGGPAGLGLTPSAWEASSLRSSRHSGLSHF

SEQ ID NO: 558 - DNA, 1077 bp, Homo sapiens
atgggcaatgcctccaatgactcccagtctgaggactgcgagacgcgacagtggcttcccccaggcgaaagcccagccatcagctccgtcatgttctcggccggggtgctggggaacctcatagcactggcgctgctggcgcgccgctggcggggggacgtggggtgcagcgccggccgcaggagctccctctccttgttccacgtgctggtgaccgagctggtgttcaccgacctgctcgggacctgcctcatcagcccagtggtactggcttcgtacgcgcggaaccagaccctggtggcactggcgcccgagagccgcgcgtgcacctacttcgctttcgccatgaccttcttcagcctggccacgatgctcatgctcttcgccatggccctggagcgctacctctcgatcgggcacccctacttctaccagcgccgcgtctcggcctccgggggcctggccgtgctgcctgtcatctatgcagtctccctgctcttctgctcgctgccgctgctggactatgggcagtacgtccagtactgccccgggacctggtgcttcatccggcacgggcggaccgcttacctgcagctgtacgccaccctgctgctgcttctcattgtctcggtgctcgcctgcaacttcagtgtcattctcaacctcatccgcatgcaccgccgaagccggagaagccgctgcggaccttccctgggcagtggccggggcggccccggggcccgcaggagaggggaaagggtgtccatggcggaggagacggaccacaagattctcctggctatcatgaccatcaccttcgccgtctgctccttgcctttcacgatttttgcatatatgaatgaaacctcttcccgaaaggaaaaatgggacctccaagctcttaggtttttatcaattaattcaataattgacccttgggtctttgccatccttaggcctcctgttctgagactaatgcgttcagtcctctgttgtcggatttcattaagaacacaagatgcaacacaaacttcctgttctacacagtcagatgccagtaaacaggctgacctttga

SEQ ID NO: 559 - protein, 358 aa, Homo sapiens
MGNASNDSQSEDCETRQWLPPGESPAISSVMFSAGVLGNLIALALLARRWRGDVGCSAGRRSSLSLFHVLVTELVFTDLLGTCLISPVVLASYARNQTLVALAPESRACTYFAFAMTFFSLATMLMLFAMALERYLSIGHPYFYQRRVSASGGLAVLPVIYAVSLLFCSLPLLDYGQYVQYCPGTWCFIRHGRTAYLQLYATLLLLLIVSVLACNFSVILNLIRMHRRSRRSRCGPSLGSGRGGPGARRRGERVSMAEETDHKILLAIMTITFAVCSLPFTIFAYMNETSSRKEKWDLQALRFLSINSIIDPWVFAILRPPVLRLMRSVLCCRISLRTQDATQTSCSTQSDASKQADL

SEQ ID NO: 560 - DNA, 1467 bp, Homo sapiens
atgtccactcccggggtcaattcgtccgcctccttgagccccgaccggctgaacagcccagtgaccatcccggcggtgatgttcatcttcggggtggtgggcaacctggtggccatcgtggtgctgtgcaagtcgcgcaaggagcagaaggagacgaccttctacacgctggtatgtgggctggctgtcaccgacctgttgggcactttgttggtgagcccggtgaccatcgccacgtacatgaagggccaatggcccgggggccagccgctgtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctccttcctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgccgcgcctcagcgactttcggcgccgccggagcttccgccgcatcgcgggcgccgagatccagatgaagatcttactcattgccacctccctggtggtgctcatctgctccatcccgctcgtggtgcgagtattcgtcaaccagttatatcagccaagtttggagcgagaagtcagtaaaaatccagatttgcaggccatccgaattgcttctgtgaaccccatcctagacccctggatatatatcctcctgagaaagacagtgctcagtaaagcaatagagaagatcaaatgcctcttctgccgcattggcgggtcccgcagggagcgctccggacagcactgctcagacagtcaaaggacatcttctgccatgtcaggccactctcgctccttcatctcccgggagctgaaggagatcagcagtacatctcagaccctcctgccagacctctcactgccagacctcagtgaaaatggccttggaggcaggaatttgcttccaggtgtgcctggcatgggcctggcccaggaagacaccacctcactgaggactttgcgaatatcagagacctcagactcttcacagggtcaggactcagagagtgtcttactggtggatgaggctggtgggagcggcagggctgggcctgcccctaaggggagctccctgcaagtcacatttcccagtgaaacactgaacttatcagaaaaatgtatataa

SEQ ID NO: 561 - protein, 488 aa, Homo sapiens
MSTPGVNSSASLSPDRLNSPVTIPAVMFIFGVVGNLVAIVVLCKSRKEQKETTFYTLVCGLAVTDLLGTLLVSPVTIATYMKGQWPGGQPLCEYSTFILLFFSLSGLSIICAMSVERYLAINHAYFYSHYVDKRLAGLTLFAVYASNVLFCALPNMGLGSSRLQYPDTWCFIDWTTNVTAHAAYSYMYAGFSSFLILATVLCNVLVCGALLRMHRQFMRRTSLGTEQHHAAAAASVASRGHPAASPALPRLSDFRRRRSFRRIAGAEIQMKILLIATSLVVLICSIPLVVRVFVNQLYQPSLEREVSKNPDLQAIRIASVNPILDPWIYILLRKTVLSKAIEKIKCLFCRIGGSRRERSGQHCSDSQRTSSAMSGHSRSFISRELKEISSTSQTLLPDLSLPDLSENGLGGRNLLPGVPGMGLAQEDTTSLRTLRISETSDSSQGQDSESVLLVDEAGGSGRAGPAPKGSSLQVTFPSETLNLSEKCI

SEQ ID NO: 562 - DNA, 1782 bp, Homo sapiens
atggggaccgcccggatcgcacccggcctggcgctcctgctctgctgccccgtgctcagctccgcgtacgcgctggtggatgcagatgacgtcatgactaaagaggaacagatcttcctgctgcaccgtgctcaggcccagtgcgaaaaacggctcaaggaggtcctgcagaggccagccagcataatggaatcagacaagggatggacatctgcgtccacatcagggaagcccaggaaagataaggcatctgggaagctctaccctgagtctgaggaggacaaggaggcacccactggcagcaggtaccgagggcgcccctgtctgccggaatgggaccacatcctgtgctggccgctgggggcaccaggtgaggtggtggctgtgccctgtccggactacatttatgacttcaatcacaaaggccatgcctaccgacgctgtgaccgcaatggcagctgggagctggtgcctgggcacaacaggacgtgggccaactacagcgagtgtgtcaaatttctcaccaatgagactcgtgaacgggaggtgtttgaccgcctgggcatgatttacaccgtgggctactccgtgtccctggcgtccctcaccgtagctgtgctcatcctggcctactttaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtctgcccgctgtcttcgtggctgtgtgggtcagtgtcagagctaccctggccaacaccgggtgctgggacttgagctccgggaacaaaaagtggatcatccaggtgcccatcctggcctccattgtgctcaacttcatcctcttcatcaatatcgtccgggtgctcgccaccaagctgcgggagaccaacgccggccggtgtgacacacggcagcagtaccggaagctgctcaaatccccgctggtgctcatgcccctctttggcgtccactacattgtcttcatggccacaccatacaccgaggtctcagggacgctctggcaagtccagatgcactatgagatgctcttcaactccttccagggattttttgtcgcaatcatatactgtttctgcaatggcgaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagctgcctggccatgccaagccagggaccccagccctggagaccctcgagaccacaccacctgccatggctgctcccaaggacgatgggttcctcaacggctcctgctcaggcctggacgaggaggcctctgggcctgagcggccacctgccctgctacaggaagagtgggagacagtcatgtga

SEQ ID NO: 563 - protein, 593 aa, Homo sapiens
MGTARIAPGLALLLCCPVLSSAYALVDADDVMTKEEQIFLLHRAQAQCEKRLKEVLQRPASIMESDKGWTSASTSGKPRKDKASGKLYPESEEDKEAPTGSRYRGRPCLPEWDHILCWPLGAPGEVVAVPCPDYIYDFNHKGHAYRRCDRNGSWELVPGHNRTWANYSECVKFLTNETREREVFDRLGMIYTVGYSVSLASLTVAVLILAYFRRLHCTRNYIHMHLFLSFMLRAVSIFVKDAVLYSGATLDEAERLTEEELRAIAQAPPPPATAAAGYAGCRVAVTFFLYFLATNYYWILVEGLYLHSLIFMAFFSEKKYLWGFTVFGWGLPAVFVAVWVSVRATLANTGCWDLSSGNKKWIIQVPILASIVLNFILFINIVRVLATKLRETNAGRCDTRQQYRKLLKSPLVLMPLFGVHYIVFMATPYTEVSGTLWQVQMHYEMLFNSFQGFFVAIIYCFCNGEVQAEIKKSWSRWTLALDFKRKARSGSSSYSYGPMVSHTSVTNVGPRVGLGLPLSPRLLPTATTNGHPQLPGHAKPGTPALETLETTPPAMAAPKDDGFLNGSCSGLDEEASGPERPPALLQEEWETVM

SEQ ID NO: 564 - DNA, 1653 bp, Homo sapiens
atggccgggctgggggcgtcgctccacgtctggggttggctaatgctcggcagctgcctcctggccagagcccagctggattctgatggcaccattactatagaggagcagattgtccttgtgctgaaagcgaaagtacaatgtgaactcaacatcacagctcaactccaggagggagaaggtaattgtttccctgaatgggatggactcatttgttggcccagaggaacagtggggaaaatatcggctgttccatgccctccttatatttatgacttcaaccataaaggagttgctttccgacactgtaaccccaatggaacatgggattttatgcacagcttaaataaaacatgggccaattattcagactgccttcgctttctgcagccagatatcagcataggaaagcaagaattctttgaacgcctctatgtaatgtataccgttggctactccatctcttttggttccttggctgtggctattctcatcattggttacttcagacgattgcattgcactaggaactatatccacatgcacttatttgtgtctttcatgctgagagctacaagcatctttgtcaaagacagagtagtccatgctcacataggagtaaaggagctggagtccctaataatgcaggatgacccacaaaattccattgaggcaacttctgtggacaaatcacaatatatcgggtgcaagattgctgttgtgatgtttatttacttcctggctacaaattattattggatcctggtggaaggtctctacctgcataatctcatctttgtggctttcttttcggacaccaaatacctgtggggcttcatcttgataggctgggggtttccagcagcatttgttgcagcatgggctgtggcacgagcaactctggctgatgcgaggtgctgggaacttagtgctggagacatcaagtggatttatcaagcaccgatcttagcagctattgggctgaattttattctgtttctgaatacggttagagttctagctaccaaaatctgggagaccaatgcagttgggcatgacacaaggaagcaatacaggaaactggccaaatcgccactggtcctggtcctagtctttggagtgcattacatcgtgttcgtatgcctgcctcactccttcactgggctcgggtgggagatccgcatgcactgtgagctcttcttcaactcctttcagggtttctttgtgtctatcatctactgctactgcaatggagaggttcaggcagaggtgaagaagatgtggagtcggtggaatctctccgtggactggaaaaggacaccgccatgtggcagccgcagatgcggctcagtgctcaccaccgtgacgcacagcaccagcagccagtcacaggtggcggccagcacacgcatggtgcttatctctggcaaagctgccaagatcgccagcagacagcctgacagccacatcactttacctggctatgtctggagtaactcagagcaggactgcctgccacactctttccacgaggagaccaaggaagatagtgggaggcagggagatgatattctaatggagaagccttccaggcctatggaatctaacccagacactgaaggatgccaaggagaaactgaggatgttctctga

SEQ ID NO: 565 - protein, 550 aa, Homo sapiens
MAGLGASLHVWGWLMLGSCLLARAQLDSDGTITIEEQIVLVLKAKVQCELNITAQLQEGEGNCFPEWDGLICWPRGTVGKISAVPCPPYIYDFNHKGVAFRHCNPNGTWDFMHSLNKTWANYSDCLRFLQPDISIGKQEFFERLYVMYTVGYSISFGSLAVAILIIGYFRRLHCTRNYIHMHLFVSFMLRATSIFVKDRVVHAHIGVKELESLIMQDDPQNSIEATSVDKSQYIGCKIAVVMFIYFLATNYYWILVEGLYLHNLIFVAFFSDTKYLWGFILIGWGFPAAFVAAWAVARATLADARCWELSAGDIKWIYQAPILAAIGLNFILFLNTVRVLATKIWETNAVGHDTRKQYRKLAKSPLVLVLVFGVHYIVFVCLPHSFTGLGWEIRMHCELFFNSFQGFFVSIIYCYCNGEVQAEVKKMWSRWNLSVDWKRTPPCGSRRCGSVLTTVTHSTSSQSQVAASTRMVLISGKAAKIASRQPDSHITLPGYVWSNSEQDCLPHSFHEETKEDSGRQGDDILMEKPSRPMESNPDTEGCQGETEDVL

SEQ ID NO: 566 - DNA, 1323 bp, Homo sapiens
atgcgtccccacctgtcgccgccgctgcagcagctactactgccggtgctgctcgcctgcgccgcgcactcgactggagcccttccccgactatgtgacgtgctacaagtgctgtgggaagagcaagaccagtgcctgcaggaactctccagagagcagacaggagacctgggcacggagcagccagtgccaggttgtgaggggatgtgggacaacataagctgctggccctcttctgtgccgggccggatggtggaggtggaatgcccgagattcctccggatgctcaccagcagaaatggttccttgttccgaaactgcacacaggatggctggtcagaaaccttccccaggcctaatctggcctgtggcgttaatgtgaacgactcttccaacgagaagcggcactcctacctgctgaagctgaaagtcatgtacaccgtgggctacagctcctccctggtcatgctcctggtcgcccttggcatcctctgtgctttccggaggctccactgcactcgcaactacatccacatgcacctgttcgtgtccttcatccttcgtgccctgtccaacttcatcaaggacgccgtgctcttctcctcagatgatgtcacctactgcgatccgcacagggcgggctgcaagctggtcatggtgctgttccagtactgcatcatggccaactactcctggctgctggtggaaggcctctaccttcacacactcctcgccatctccttcttctctgaaagaaagtacctccagggatttgtggcattcggatggggttctccagccatttttgttgctttgtgggctattgccagacactttctggaagatgttgggtgctgggacatcaatgccaacgcatccatctggtggatcattcgtggtcctgtgatcctctccatcctgattaatttcatccttttcataaacattctaagaatcctgatgagaaaacttagaacccaagaaacaagaggaaatgaagtcagccattataagcgcctggccaggtcccctctcctgctgatccccctctttggcatccactacatcgtcttcgccttctccccagaggacgctatggagatccagctgttttttgaactagcccttggctcattccagggactggtggtggccgtcctctactgcttcctcaatggggaggtgcagctggaggttcagaagaagtggcagcaatggcacctccgtgagttcccactgcaccccgtggcctccttcagcaacagcaccaaggccagccacttggagcagagccagggcacctgcaggaccagcatcatctga

SEQ ID NO: 567 - protein, 440 aa, Homo sapiens
MRPHLSPPLQQLLLPVLLACAAHSTGALPRLCDVLQVLWEEQDQCLQELSREQTGDLGTEQPVPGCEGMWDNISCWPSSVPGRMVEVECPRFLRMLTSRNGSLFRNCTQDGWSETFPRPNLACGVNVNDSSNEKRHSYLLKLKVMYTVGYSSSLVMLLVALGILCAFRRLHCTRNYIHMHLFVSFILRALSNFIKDAVLFSSDDVTYCDPHRAGCKLVMVLFQYCIMANYSWLLVEGLYLHTLLAISFFSERKYLQGFVAFGWGSPAIFVALWAIARHFLEDVGCWDINANASIWWIIRGPVILSILINFILFINILRILMRKLRTQETRGNEVSHYKRLARSPLLLIPLFGIHYIVFAFSPEDAMEIQLFFELALGSFQGLVVAVLYCFLNGEVQLEVQKKWQQWHLREFPLHPVASFSNSTKASHLEQSQGTCRTSII

SEQ ID NO: 568 - DNA, 1176 bp, Homo sapiens
atgttccccaatggcaccgcctcctctccttcctcctctcctagccccagcccgggcagctgcggcgaaggcggcggcagcaggggccccggggccggcgctgcggacggcatggaggagccagggcgaaatgcgtcccagaacgggaccttgagcgagggccagggcagcgccatcctgatctctttcatctactccgtggtgtgcctggtggggctgtgtgggaactctatggtcatctacgtgatcctgcgctatgccaagatgaagacggccaccaacatctacatcctaaatctggccattgctgatgagctgctcatgctcagcgtgcccttcctagtcacctccacgttgttgcgccactggcccttcggtgcgctgctctgccgcctcgtgctcagcgtggacgcggtcaacatgttcaccagcatctactgtctgactgtgctcagcgtggaccgctacgtggccgtggtgcatcccatcaaggcggcccgctaccgccggcccaccgtggccaaggtagtaaacctgggcgtgtgggtgctatcgctgctcgtcatcctgcccatcgtggtcttctctcgcaccgcggccaacagcgacggcacggtggcttgcaacatgctcatgccagagcccgctcaacgctggctggtgggcttcgtgttgtacacatttctcatgggcttcctgctgcccgtgggggctatctgcctgtgctacgtgctcatcattgctaagatgcgcatggtggccctcaaggccggctggcagcagcgcaagcgctcggagcgcaagatcaaattaatggtgatgatggtggtgatggtgtttgtcatctgctggatgcctttctacgtggtgcagctggttaacgtgtttgctgagcaggacgacgccacggtgagtcagctgtcggtcatcctcggctatgccaacagctgcgccaaccccatcctctatggctttctctcagacaacttcaagcgctctttccaacgcatcctatgcctcagctggatggacaacgccgcggaggagccggttgactattacgccaccgcgctcaagagccgtgcctacagtgtggaagacttccaacctgagaacctggagtccggcggcgtcttccgtaatggcacctgcacgtcccggatcacgacgctctga

SEQ ID NO: 569 - protein, 391 aa, Homo sapiens
MFPNGTASSPSSSPSPSPGSCGEGGGSRGPGAGAADGMEEPGRNASQNGTLSEGQGSAILISFIYSVVCLVGLCGNSMVIYVILRYAKMKTATNIYILNLAIADELLMLSVPFLVTSTLLRHWPFGALLCRLVLSVDAVNMFTSIYCLTVLSVDRYVAVVHPIKAARYRRPTVAKVVNLGVWVLSLLVILPIVVFSRTAANSDGTVACNMLMPEPAQRWLVGFVLYTFLMGFLLPVGAICLCYVLIIAKMRMVALKAGWQQRKRSERKIKLMVMMVVMVFVICWMPFYVVQLVNVFAEQDDATVSQLSVILGYANSCANPILYGFLSDNFKRSFQRILCLSWMDNAAEEPVDYYATALKSRAYSVEDFQPENLESGGVFRNGTCTSRITTL

SEQ ID NO: 570 - DNA, 1110 bp, Homo sapiens
atggacatggcggatgagccactcaatggaagccacacatggctatccattccatttgacctcaatggctctgtggtgtcaaccaacacctcaaaccagacagagccgtactatgacctgacaagcaatgcagtcctcacattcatctattttgtggtctgcatcattgggttgtgtggcaacacacttgtcatttatgtcatcctccgctatgccaagatgaagaccatcaccaacatttacatcctcaacctggccatcgcagatgagctcttcatgctgggtctgcctttcttggctatgcaggtggctctggtccactggccctttggcaaggccatttgccgggtggtcatgactgtggatggcatcaatcagttcaccagcatcttctgcctgacagtcatgagcatcgaccgatacctggctgtggtccaccccatcaagtcggccaagtggaggagaccccggacggccaagatgatcaccatggctgtgtggggagtctctctgctggtcatcttgcccatcatgatatatgctgggctccggagcaaccagtgggggagaagcagctgcaccatcaactggccaggtgaatctggggcttggtacacagggttcatcatctacactttcattctggggttcctggtacccctcaccatcatctgtctttgctacctgttcattatcatcaaggtgaagtcctctggaatccgagtgggctcctctaagaggaagaagtctgagaagaaggtcaaacgaatggtgtccatcgtggtggctgtcttcatcttctgctggcttcccttctacatattcaacgtttcttccgtctccatggccatcagccccaccccagcccttaaaggcatgtttgactttgtggtggtcctcacctatgctaacagctgtgccaaccctatcctatatgccttcttgtctgacaacttcaagaagagcttccagaatgtcctctgcttggtcaaggtgagcggcacagatgatggggagcggagtgacagtaagcaggacaaatcccggctgaatgagaccacggagacccagaggaccctcctcaatggagacctccaaaccagtatctga

SEQ ID NO: 571 - protein, 369 aa, Homo sapiens
MDMADEPLNGSHTWLSIPFDLNGSVVSTNTSNQTEPYYDLTSNAVLTFIYFVVCIIGLCGNTLVIYVILRYAKMKTITNIYILNLAIADELFMLGLPFLAMQVALVHWPFGKAICRVVMTVDGINQFTSIFCLTVMSIDRYLAVVHPIKSAKWRRPRTAKMITMAVWGVSLLVILPIMIYAGLRSNQWGRSSCTINWPGESGAWYTGFIIYTFILGFLVPLTIICLCYLFIIIKVKSSGIRVGSSKRKKSEKKVKRMVSIVVAVFIFCWLPFYIFNVSSVSMAISPTPALKGMFDFVVVLTYANSCANPILYAFLSDNFKKSFQNVLCLVKVSGTDDGERSDSKQDKSRLNETTETQRTLLNGDLQTSI

SEQ ID NO: 572 - DNA, 1257 bp, Homo sapiens
atggacatgcttcatccatcatcggtgtccacgacctcagaacctgagaatgcctcctcggcctggcccccagatgccaccctgggcaacgtgtcggcgggcccaagcccggcagggctggccgtcagtggcgttctgatccccctggtctacctggtggtgtgcgtggtgggcctgctgggtaactcgctggtcatctatgtggtcctgcggcacacggccagcccttcagtcaccaacgtctacatcctcaacctggcgctggccgacgagctcttcatgctggggctgcccttcctggccgcccagaacgccctgtcctactggcccttcggctccctcatgtgccgcctggtcatggcggtggatggcatcaaccagttcaccagcatattctgcctgactgtcatgagcgtggaccgctacctggccgtggtacatcccacccgctcggcccgctggcgcacagctccggtggcccgcacggtcagcgcggctgtgtgggtggcctcagccgtggtggtgctgcccgtggtggtcttctcgggagtgccccgcggcatgagcacctgccacatgcagtggcccgagccggcggcggcctggcgagccggcttcatcatctacacggccgcactgggcttcttcgggccgctgctggtcatctgcctctgctacctgctcatcgtggtgaaggtgcgctcagctgggcgccgggtgtgggcaccctcgtgccagcggcgccggcgctccgaacgcagggtcaagcgcatggtggtggccgtggtggcgctcttcgtgctctgctggatgcccttctacgtgctcaacatcgtcaacgtggtgtgcccactgcccgaggagcctgccttctttgggctctacttcctggtggtggcgctgccctatgccaacagctgtgccaaccccatcctttatggcttcctctcctaccgcttcaagcagggcttccgcagggtcctgctgcggccctcccgccgtgtgcgcagccaggagcccactgtggggcccccggagaagactgaggaggaggatgaggaggaggaggatggggaggagagcagggaggggggcaaggggaaggagatgaacggccgggtcagccagatcacgcagcctggcaccagcgggcaggagcggccgcccagcagagtggccagcaaggagcagcagctcctaccccaagaggcttccactggggagaagtccagcacgatgcgcatcagctacctgtag

SEQ ID NO: 573 - protein, 418 aa, Homo sapiens
MDMLHPSSVSTTSEPENASSAWPPDATLGNVSAGPSPAGLAVSGVLIPLVYLVVCVVGLLGNSLVIYVVLRHTASPSVTNVYILNLALADELFMLGLPFLAAQNALSYWPFGSLMCRLVMAVDGINQFTSIFCLTVMSVDRYLAVVHPTRSARWRTAPVARTVSAAVWVASAVVVLPVVVFSGVPRGMSTCHMQWPEPAAAWRAGFIIYTAALGFFGPLLVICLCYLLIVVKVRSAGRRVWAPSCQRRRRSERRVKRMVVAVVALFVLCWMPFYVLNIVNVVCPLPEEPAFFGLYFLVVALPYANSCANPILYGFLSYRFKQGFRRVLLRPSRRVRSQEPTVGPPEKTEEEDEEEEDGEESREGGKGKEMNGRVSQITQPGTSGQERPPSRVASKEQQLLPQEASTGEKSSTMRISYL

SEQ ID NO: 574 - DNA, 1167 bp, Homo sapiens
atgagcgccccctcgacgctgccccccgggggcgaggaagggctggggacggcctggccctctgcagccaatgccagtagcgctccggcggaggcggaggaggcggtggcggggcccggggacgcgcgggcggcgggcatggtcgctatccagtgcatctacgcgctggtgtgcctggtggggctggtgggcaacgccctggtcatcttcgtgatccttcgctacgccaagatgaagacggctaccaacatctacctgctcaacctggccgtagccgacgagctcttcatgctgagcgtgcccttcgtggcctcgtcggccgccctgcgccactggcccttcggctccgtgctgtgccgcgcggtgctcagcgtcgacggcctcaacatgttcaccagcgtcttctgtctcaccgtgctcagcgtggaccgctacgtggccgtggtgcaccctctgcgcgcggcgacctaccggcggcccagcgtggccaagctcatcaacctgggcgtgtggctggcatccctgttggtcactctccccatcgccatcttcgcagacaccagaccggctcgcggcggccaggccgtggcctgcaacctgcagtggccacacccggcctggtcggcagtcttcgtggtctacactttcctgctgggcttcctgctgcccgtgctggccattggcctgtgctacctgctcatcgtgggcaagatgcgcgccgtggccctgcgcgctggctggcagcagcgcaggcgctcggagaagaaaatcaaaaggctggtgctgatggtcgtggtcgtctttgtgctctgctggatgcctttctacgtggtgcagctgctgaacctcgtcgtgaccagccttgatgccaccgtcaaccacgtgtcccttatcctcagctatgccaacagctgcgccaaccctattctctatggcttcctctccgacaacttccgccgatccttccagcgggttctctgcctgcgctgctgcctcctggaaggtgctggaggtgctgaggaggagcccctggactactatgccactgctctcaagagcaaaggtggggcagggtgcatgtgccccccactcccctgccagcaggaagccctgcaaccagaacccggccgcaagcgcatccccctcaccaggaccaccaccttctga

SEQ ID NO: 575 - protein, 388 aa, Homo sapiens
MSAPSTLPPGGEEGLGTAWPSAANASSAPAEAEEAVAGPGDARAAGMVAIQCIYALVCLVGLVGNALVIFVILRYAKMKTATNIYLLNLAVADELFMLSVPFVASSAALRHWPFGSVLCRAVLSVDGLNMFTSVFCLTVLSVDRYVAVVHPLRAATYRRPSVAKLINLGVWLASLLVTLPIAIFADTRPARGGQAVACNLQWPHPAWSAVFVVYTFLLGFLLPVLAIGLCYLLIVGKMRAVALRAGWQQRRRSEKKIKRLVLMVVVVFVLCWMPFYVVQLLNLVVTSLDATVNHVSLILSYANSCANPILYGFLSDNFRRSFQRVLCLRCCLLEGAGGAEEEPLDYYATALKSKGGAGCMCPPLPCQQEALQPEPGRKRIPLTRTTTF

SEQ ID NO: 576 - DNA, 1095 bp, Homo sapiens
atggagcccctgttcccagcctccacgcccagctggaacgcctcctccccgggggctgcctctggaggcggtgacaacaggacgctggtggggccggcgccctcggcaggggcccgggcggtgctggtgcccgtgctgtacctgctggtgtgtgcggccgggctgggcgggaacacgctggtcatctacgtggtgctgcgcttcgccaagatgaagaccgtcaccaacatctacattctcaacctggcagtggccgacgtcctgtacatgctggggctgcctttcctggccacgcagaacgccgcgtccttctggcccttcggccccgtcctgtgccgcctggtcatgacgctggacggcgtcaaccagttcaccagtgtcttctgcctgacagtcatgagcgtggaccgctacctggcagtggtgcacccgctgagctcggcccgctggcgccgcccgcgtgtggccaagctggcgagcgccgcggcctgggtcctgtctctgtgcatgtcgctgccgctcctggtgttcgcggacgtgcaggagggcggtacctgcaacgccagctggccggagcccgtggggctgtggggcgccgtcttcatcatctacacggccgtgctgggcttcttcgcgccgctgctggtcatctgcctgtgctacctgctcatcgtggtgaaggtgagggcggcgggcgtgcgcgtgggctgcgtgcggcggcgctcggagcggaaggtgaagcgcatggtgttggtggtggtgctggtgtttgcgggatgttggctgcccttcttcaccgtcaacatcgtcaacctggccgtggcgctgccccaggagcccgcctccgccggcctctacttcttcgtggtcatcctctcctacgccaacagctgtgccaaccccgtcctctacggcttcctctctgacaacttccgccagagcttccagaaggttctgtgcctccgcaagggctctggtgccaaggacgctgacgccacggagccgcgtccagacaggatccggcagcagcaggaggccacgccgcccgcgcaccgcgccgcagccaacgggcttatgcagaccagcaagctgtga

SEQ ID NO: 577 - protein, 364 aa, Homo sapiens
MEPLFPASTPSWNASSPGAASGGGDNRTLVGPAPSAGARAVLVPVLYLLVCAAGLGGNTLVIYVVLRFAKMKTVTNIYILNLAVADVLYMLGLPFLATQNAASFWPFGPVLCRLVMTLDGVNQFTSVFCLTVMSVDRYLAVVHPLSSARWRRPRVAKLASAAAWVLSLCMSLPLLVFADVQEGGTCNASWPEPVGLWGAVFIIYTAVLGFFAPLLVICLCYLLIVVKVRAAGVRVGCVRRRSERKVKRMVLVVVLVFAGCWLPFFTVNIVNLAVALPQEPASAGLYFFVVILSYANSCANPVLYGFLSDNFRQSFQKVLCLRKGSGAKDADATEPRPDRIRQQQEATPPAHRAAANGLMQTSKL

SEQ ID NO: 578 - DNA, 1374 bp, Homo sapiens
atgcgcccgccaagtccgctgcccgcccgctggctatgcgtgctggcaggcgccctcgcctgggcccttgggccggcgggcggccaggcggccaggctgcaggaggagtgtgactatgtgcagatgatcgaggtgcagcacaagcagtgcctggaggaggcccagctggagaatgagacaataggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccatcggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccccactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctga

SEQ ID NO: 579 - protein, 457 aa, Homo sapiens
MRPPSPLPARWLCVLAGALAWALGPAGGQAARLQEECDYVQMIEVQHKQCLEEAQLENETIGCSKMWDNLTCWPATPRGQVVVLACPLIFKLFSSIQGRNVSRSCTDEGWTHLEPGPYPIACGLDDKAASLDEQQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSPLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 580 - DNA, 1317 bp, Homo sapiens
atgcggacgctgctgcctcccgcgctgctgacctgctggctgctcgcccccgtgaacagcattcacccagaatgccgatttcatctggaaatacaggaggaagaaacaaaatgtacagagcttctgaggtctcaaacagaaaaacacaaagcctgcagtggcgtctgggacaacatcacgtgctggcggcctgccaatgtgggagagaccgtcacggtgccctgcccaaaagtcttcagcaatttttacagcaaagcaggaaacataagcaaaaactgtacgagtgacggatggtcagagacgttcccagatttcgtcgatgcctgtggctacagcgacccggaggatgagagcaagatcacgttttatattctggtgaaggccatttataccctgggctacagtgtctctctgatgtctcttgcaacaggaagcataattctgtgcctcttcaggaagctgcactgcaccaggaattacatccacctgaacctgttcctgtccttcatcctgagagccatctcagtgctggtcaaggacgacgttctctactccagctctggcacgttgcactgccctgaccagccatcctcctgggtgggctgcaagctgagcctggtcttcctgcagtactgcatcatggccaacttcttctggctgctggtggaggggctctacctccacaccctcctggtggccatgctcccccctagaaggtgcttcctggcctacctcctgatcggatggggcctccccaccgtctgcatcggtgcatggactgcggccaggctctacttagaagacaccggttgctgggatacaaacgaccacagtgtgccctggtgggtcatacgaataccgattttaatttccatcatcgtcaattttgtccttttcattagtattatacgaattttgctgcagaagttaacatccccagatgtcggcggcaacgaccagtctcagtacaagaggctggccaagtccccgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtgcagtgcgagctgaagcgaaaatggcgaagccggtgcccgaccccgtccgcgagccgggattacagggtctgcggttcctccttctcccacaacggctcggagggcgccctgcagttccaccgcgcgtcccgagcccagtccttcctgcaaacggagacctcggtcatctag

SEQ ID NO: 581 - protein, 438 aa, Homo sapiens
MRTLLPPALLTCWLLAPVNSIHPECRFHLEIQEEETKCTELLRSQTEKHKACSGVWDNITCWRPANVGETVTVPCPKVFSNFYSKAGNISKNCTSDGWSETFPDFVDACGYSDPEDESKITFYILVKAIYTLGYSVSLMSLATGSIILCLFRKLHCTRNYIHLNLFLSFILRAISVLVKDDVLYSSSGTLHCPDQPSSWVGCKLSLVFLQYCIMANFFWLLVEGLYLHTLLVAMLPPRRCFLAYLLIGWGLPTVCIGAWTAARLYLEDTGCWDTNDHSVPWWVIRIPILISIIVNFVLFISIIRILLQKLTSPDVGGNDQSQYKRLAKSPLLLIPLFGVHYMVFAVFPISISSKYQILFELCLGSFQGLVVAVLYCFLNSEVQCELKRKWRSRCPTPSASRDYRVCGSSFSHNGSEGALQFHRASRAQSFLQTETSVI

SEQ ID NO: 582 - DNA, 32 bp, Homo sapiens
gatctctagaatgaggccggcggacttgctgc

SEQ ID NO: 583 - DNA, 33 bp, Homo sapiens
ctaggatatccgcaaaaccgtttgcatatactc

SEQ ID NO: 584 - DNA, 30 bp, Homo sapiens
gtgaagcttgcccgggcaggatggacctgg

SEQ ID NO: 585 - DNA, 24 bp, Homo sapiens
atctagaggtgcctttgctttctg

SEQ ID NO: 586 - DNA, 3549 bp, Homo sapiens
atgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagtccttggcattttcaaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgatttctttgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacagctggactcttaagaaacttgcactttccttgagtttccttcacctcacacgggctgacctttcttacccaagccactgctgtgcttttaagaatcagaagaaaatcagaggaatccttgagtccttgatgtgtaatgagagcagtatcgagacgttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggctacaagttcctgagaattgtggtgtggttcgttagtctgctggctctcctgggcaatgtctttgtcctgcttattctcctcaccagccactacaaactgaacgtcccccgctttctcatgtgcaacctggcctttgcggatttctgcatggggatgtacctgctcctcatcgcctctgtagacctctacactcactctgagtactacaaccatgccatcgactggcagacaggccctgggtgcaacacggctggtttcttcactgtctttgcaagcgagttatcggtgtatacgctgacggtcatcaccctggagcgctggtatgccatcaccttcgccatggccctggaccggaagatccgcctcaggcacgcatgtgccatcatggttgggggctgggtttgctgcttccttctcgccctgcttcctttggtgggaataagtagctatgccaaagtcagtatctgcctgcccatggacaccgagacccctcttgctctggcatatattgtttttgttctgacgctcaacatagttgccttcgtcatcgtctgctgctgttatgtgaagatctacatcacagtccgaaatccgcagtacaacccaggggacaaagataccaaaattaagaagaggatggctgtgttgatcttcaccgacttcacgtgcatggccccaatctcattctatgctgtgtcagcaattctgaacaagcctctcatcactgttagcaactccaaaatcttgctggtactcttctatccaattaactcctgtgccaatccattcctctatgctattttcaccaaggccttccagagggatgtgttcatcctactcagcaagtttggcatctgtaaacgccaggctcaggcataccgggggcagagggttcctccaaagaacagcactgatattcaggttcaaaaggttacccacgacatgaggcagggtctccacaacatggaagatgtctatgaactgattgaaaactcccatctaaccccaaagaagcaaggccaaatctcagaagagtatatgcaaacggttttggcgatatctgcagaattccaccacactggactagtggatccgagctcggtaccaagcttgggctgcaggtcgatgggctgcctcggcaacagtaagaccgaggaccagcgcaacgaggagaaggcgcagcgcgaggccaacaaaaagatcgagaagcagctgcagaaggacaagcaggtctaccgggccacgcaccgcctgctgctgctgggtgctggagagtctggcaaaagcaccattgtgaagcagatgaggatcctacatgttaatgggtttaacggagagggcggcgaagaggacccgcaggctgcaaggagcaacagcgatggtgagaaggccaccaaagtgcaggacatcaaaaacaacctgaaggaggccattgaaaccattgtggccgccatgagcaacctggtgccccccgtggagctggccaaccctgagaaccagttcagagtggactacattctgagcgtgatgaacgtgccaaactttgacttcccacctgaattctatgagcatgccaaggctctgtgggaggatgagggagttcgtgcctgctacgagcgctccaacgagtaccagctgatcgactgtgcccagtacttcctggacaagattgatgtgatcaagcaggccgactacgtgccaagtgaccaggacctgcttcgctgccgcgtcctgacctctggaatctttgagaccaagttccaggtggacaaagtcaacttccacatgttcgatgtgggcggccagcgcgatgaacgccgcaagtggatccagtgcttcaatgatgtgactgccatcatcttcgtggtggccagcagcagctacaacatggtcatccgggaggacaaccagaccaaccgtctgcaggaggctctgaacctcttcaagagcatctggaacaacagatggctgcgtaccatctctgtgatcctcttcctcaacaagcaagatctgcttgctgagaaggtcctcgctgggaaatcgaagattgaggactactttccagagttcgctcgctacaccactcctgaggatgcgactcccgagcccggagaggacccacgcgtgacccgggccaagtacttcatccgggatgagtttctgagaatcagcactgctagtggagatggacgtcactactgctaccctcactttacctgcgccgtggacactgagaacatccgccgtgtcttcaacgactgccgtgacatcatccagcgcatgcatcttcgccaatacgagctgctctaa

SEQ ID NO: 587 - protein, 1181 aa, Homo sapiens [sequence omitted]

SEQ ID NO: 588 - DNA, 2133 bp, Homo sapiens
atggacctggaagcctcgctgctgcccactggtcccaatgccagcaacacctctgatggccccgataacctcacttcggcaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcggtagtagatctcctctttctcctgggcatgcccttcatgatccaccagctcatgggcaatggggtgtggcactttggggagaccatgtgcaccctcatcacggccatggatgccaatagtcagttcaccagcacctacatcctgaccgccatggccattgaccgctacctggccactgtccaccccatctcttccacgaagttccggaagccctctgtggccaccctggtgatctgcctcctgtgggccctctccttcatcagcatcacccctgtgtggctgtatgccagactcatccccttcccaggaggtgcagtgggctgcggcatacgcctgcccaacccagacactgacctctactggttcaccctgtaccagtttttcctggcctttgccctgccttttgtggtcatcacagccgcatacgtgaggatcctgcagcgcatgacgtcctcagtggcccccgcctcccagcgcagcatccggctgcggacaaagagggtgacccgcacagccatcgccatctgtctggtcttctttgtgtgctgggcaccctactatgtgctacagctgacccagttgtccatcagccgcccgaccctcacctttgtctacttatacaatgcggccatcagcttgggctatgccaacagctgcctcaacccctttgtgtacatcgtgctctgtgagacgttccgcaaacgcttggtcctgtcggtgaagcctgcagcccaggggcagcttcgcgctgtcagcaacgctcagacggctgacgaggagaggacagaaagcaaaggcacctctagaatgggctgcacactgagcgctgaggacaaggcggccgtggagcgcagcaagatgatcgaccgcaacctccgggaggacggagagaaggcagcgcgcgaggtcaagctgctgctgctgggtgctggtgaatccgggaagagcacaattgtgaagcagatgaaaattatccacgaggctggctactcagaggaagagtgtaagcagtacaaagcagtggtctacagcaacaccatccagtccatcattgccatcattagagccatggggagattgaaaatcgactttggagacgctgctcgtgcggatgatgctcgccaactcttcgtgcttgctggggctgcagaggaaggctttatgaccgcggagctcgccggcgtcataaagagactgtggaaggacagcggtgtgcaagcctgcttcaacagatcccgggagtaccagctgaacgattcggcggcgtactacctgaatgacttggacagaatagcacaaccaaattacatcccaacccagcaggatgttctcagaactagagtgaaaacgacgggaattgtggaaacccactttactttcaaagatcttcattttaaaatgtttgacgtgggaggccagagatcagagcggaagaagtggattcactgctttgaaggcgtgactgccatcatcttctgtgtggccctgagtgactatgacctggttcttgctgaggatgaagaaatgaaccggatgcatgaaagcatgaagctgttcgatagcatatgtaacaacaagtggtttacggacacatccatcatccttttcctgaacaagaaggacctcttcgaagagaagatcaaaaagagtcccctcacgatatgctatccagaatatgcaggctcaaacacatatgaagaggcggctgcgtatatccagtgtcagtttgaagacctcaataaaaggaaggacacaaaggaaatttacacccacttcacttgcgccacggatacgaagaatgtgcagtttgtgttcgatgctgtaacggacgtcatcataaagaataacctaaaagactgtggtctcttctaatct

SEQ ID NO: 589 - protein, 709 aa, Homo sapiens
MDLEASLLPTGPNASNTSDGPDNLTSAGSPPRTGSISYINIIMPSVFGTICLLGIIGNSTVIFAVVKKSKLHWCNNVPDIFIINLSVVDLLFLLGMPFMIHQLMGNGVWHFGETMCTLITAMDANSQFTSTYILTAMAIDRYLATVHPISSTKFRKPSVATLVICLLWALSFISITPVWLYARLIPFPGGAVGCGIRLPNPDTDLYWFTLYQFFLAFALPFVVITAAYVRILQRMTSSVAPASQRSIRLRTKRVTRTAIAICLVFFVCWAPYYVLQLTQLSISRPTLTFVYLYNAAISLGYANSCLNPFVYIVLCETFRKRLVLSVKPAAQGQLRAVSNAQTADEERTESKGTSRMGCTLSAEDKAAVERSKMIDRNLREDGEKAAREVKLLLLGAGESGKSTIVKQMKIIHEAGYSEEECKQYKAVVYSNTIQSIIAIIRAMGRLKIDFGDAARADDARQLFVLAGAAEEGFMTAELAGVIKRLWKDSGVQACFNRSREYQLNDSAAYYLNDLDRIAQPNYIPTQQDVLRTRVKTTGIVETHFTFKDLHFKMFDVGGQRSERKKWIHCFEGVTAIIFCVALSDYDLVLAEDEEMNRMHESMKLFDSICNNKWFTDTSIILFLNKKDLFEEKIKKSPLTICYPEYAGSNTYEEAAAYIQCQFEDLNKRKDTKEIYTHFTCATDTKNVQFVFDAVTDVIIKNNLKDCGLF

What is claimed is:

1. A method for directly identifying a non-endogenous compound as a compound having an activity selected from the group consisting of: inverse agonists, agonists, and partial agonists, to a non-endogenous, constitutively activated version of a known G protein-coupled receptor, said receptor comprising a transmembrane-6 region and an intracellular region, comprising the steps of:
   (a) selecting a non-endogenous version of a known GPCR;
   (b) confirming that the selected non-endogenous GPCR of step (a) is constitutively active;
   (c) contacting a non-endogenous candidate compound with the non-endogenous, constitutively activated GPCR of step of (b); and
   (d) determining, by measurement of the compound efficacy at said contacted receptor, whether said non-endogenous compound is an inverse agonist, an agonist, or a partial agonist to said receptor of step (b);
   wherein said receptor of step (b) comprises the amino acid sequence of SEQ ID NO:449.

2. The method of claim 1 further comprising the following step:
   assessing, by using an endogenous ligand based assay, the impact of the non-endogenous compound of step (d) on the binding of an endogenous ligand for the known GPCR version of the non-endogenous version of said known GPCR of step (a) with said known GPCR.

3. The method of claim 2 wherein said non-endogenous compound is an allosteric modulator of said known GPCR.

* * * * *